United States Patent
Keller et al.

(10) Patent No.: US 11,130,787 B2
(45) Date of Patent: Sep. 28, 2021

(54) ALPHAHERPESVIRUS GLYCOPROTEIN D-ENCODING NUCLEIC ACID CONSTRUCTS AND METHODS

(71) Applicant: MBF Therapeutics, Inc., Ambler, PA (US)

(72) Inventors: Lorraine Keller, Pipersville, PA (US); Malla Padidam, Chalfont, PA (US)

(73) Assignee: MBF Therapeutics, Inc., Ambler, PA (US)

( * ) Notice: Subject to any disclaimer, the term of this patent is extended or adjusted under 35 U.S.C. 154(b) by 0 days.

(21) Appl. No.: 16/917,899

(22) Filed: Jun. 30, 2020

(65) Prior Publication Data

US 2020/0325182 A1 Oct. 15, 2020

Related U.S. Application Data

(60) Provisional application No. 63/038,117, filed on Jun. 11, 2020.

(51) Int. Cl.
| | |
|---|---|
| *C07K 14/005* | (2006.01) |
| *C07K 14/74* | (2006.01) |
| *A61P 35/00* | (2006.01) |
| *A61K 39/00* | (2006.01) |

(52) U.S. Cl.
CPC ............ *C07K 14/005* (2013.01); *A61P 35/00* (2018.01); *C07K 14/70539* (2013.01); *A61K 2039/53* (2013.01); *A61K 2039/552* (2013.01); *A61K 2039/572* (2013.01); *A61K 2039/575* (2013.01); *A61K 2039/80* (2018.08); *C07K 2319/70* (2013.01); *C12N 2710/16021* (2013.01); *C12N 2760/16121* (2013.01); *C12N 2770/20021* (2013.01)

(58) Field of Classification Search
CPC .............. C07K 16/087; C07K 2319/00; C07K 2319/70; C12N 15/86; C12N 2710/16422; C12N 2710/16434; C12N 2710/16322; A61K 39/245; A61K 35/763; A61K 2039/523; A61K 2039/5256; A61K 2300/00; A61K 45/06; A61K 38/00; A61K 2039/5156; A61K 38/177; A61K 39/0011; A61K 39/12; A61K 39/39558; A61P 31/12; A61P 31/22

See application file for complete search history.

(56) References Cited

U.S. PATENT DOCUMENTS

| | | |
|---|---|---|
| 8,962,816 B2 | 2/2015 | Ertl et al. |
| 9,474,717 B2 | 10/2016 | Von Andian et al. |
| 9,744,424 B1 | 8/2017 | Synder et al. |
| 9,795,658 B2 | 10/2017 | Frazer et al. |
| 2002/0058021 A1 | 5/2002 | Audonnet et al. |
| 2003/0236396 A1 | 12/2003 | Fasel et al. |

FOREIGN PATENT DOCUMENTS

| | | |
|---|---|---|
| AU | 2005202233 | 6/2005 |
| WO | 2008027394 | 3/2008 |
| WO | 2011133870 | 7/2011 |
| WO | 2017177907 | 10/2017 |
| WO | 2018140890 | 8/2018 |
| WO | 2019071032 | 10/2019 |

OTHER PUBLICATIONS

Haanen et al., "Immune Checkpoint Inhibitors" Prog Tumor Res. Basel, Karger, 2015; vol. 42:pp. 55-66. doi: 10.1159/000437178.
Ibrahimi, el al., "Highly Efficient Multicistronic Lentiviral Vectors with Peptide 2A Sequences", Human Gene Therapy, Aug. 2009;20(8):845-60. doi: 10.1089/hum.2008.188.
Kourie et al., "The second wave of immune checkpoint inhibitor tsunami: advance, challenges and perspectives", Immunotherapy. Jun. 2017;9(8):647-657. doi: 10.2217/imt-2017-0029.
Li et al., "Immune Checkpoint Inhibitors: Basics and Challenges", Current Medical Chemistry, 2019; 26(17):3009-3025. doi: 10.2174/0929867324666170804143706.
Manickan et al., "DNA Vaccines—A Modem Gimmick or a Boon to Vaccinology?", Critical Reviews in Immunology, 2017;37(2-6):507-521.
Menotti, et al, "Comparison of Murine and Human Nectin1 Binding to Herpes Simplex Virus Glycoprotein D (gD) Reveals a Weak Interaction of Murine Nectin1 to gD and a gD-Dependent Pathway of Entry", Virology. 2001; 282(2):256-266.
Naidoo, et al., "Immune Checkpoint Blockade", Hematol Oncol Clin North Am. Jun. 2014;28(3):585-600. doi: 10.1016/i.hoc.2014.02.002.

(Continued)

*Primary Examiner* — Bao Q Li
(74) *Attorney, Agent, or Firm* — Transformative Legal, LLC; Len S. Smith; Denise M. Brown

(57) ABSTRACT

This invention provides new compositions comprising nucleotide sequence(s) encoding alphaherpesvirus glycoprotein D protein(s) (gDP(s)) and antigen(s) that induce immune responses. Such sequences typically encode gDP:antigen fusion proteins and typically also include feature(s) that significantly enhance immune responses such as (a) sequences encoding ITIC signal transducing adaptor proteins, e.g., SLAM-associated proteins (SAPs), Ewing's sarcoma-associated transcript 2 proteins, or both, or non-gDP checkpoint inhibitor(s); (b) sequences encoding antigen-associated targeting sequences, e.g., polyubiquitin sequences; (c) deimmunized/modified antigen-encoding sequences; (d) gDP(s) with modified sequence(s); (e) expression-enhancing introns; (f) transfection-facilitating agents; or (g) combinations thereof. Methods of using such constructs to induce immune responses and other methods and compositions also are provided, including methods of using such constructs in animals not known to express Herpesvirus entry mediator (HVEM) receptors (e.g., pigs), animals not under disease agent-associated checkpoint inhibition, and other contexts.

12 Claims, No Drawings

Specification includes a Sequence Listing.

(56) References Cited

OTHER PUBLICATIONS

Thompson AD et al., "EAT-2 is a novel SH2 domain containing protein that is up regulated by Ewing's sarcoma EWS/FLI1 fusion gene", Oncogene. Nov. 1996;13(12):2649-2658 , Abstract Only.

Zander et al., "CD4+ T Cell Help is Required for the Formation of a Cytolytic CD8+ T Cell Subset that Protects against Chronic Infection and Cancer", Immunity. Dec. 2019, vol. 51, Issue 6, 1028-1042.

Akhtar, "The Flaws and Human Harms of Animal Expiration", Cambridge Quarterly of Healthcare Ethics, Oct. 2015, 24, 407-149. doi:10.1017/S0963180115000079.

Atanley, et al., "Future Considerations for Dendritic Cell Immunotherapy Against Chronic Viral Infections", Expert Rev Clin Immunol. 2014;10(6):801-813 (2014). doi:10.1586/1744666X.2014.907742.

Bai et al., "Cytoplasmic Transport and Nuclear Import of Plasmid DNA", Bioscience Reports Dec. 22, 2017; 37(6):BSR20160616, doi: 10.1042/BSR20160616.

Chen, et al., "Dendritic cell targeted vaccines: Recent progresses and challenges", Human Vaccines Immunotherapeutics, 2016, vol. 12(3):612-622. doi:10.1080/21645515.2015.1105415.

Connolly SA, et al., "Glycoprotein D Homologs in Herpes Simplex Virus Type 1, Pseudorabies Virus, and Bovine Herpes Virus Type 1 Bind Directly to Human HveC (Nectin-1) with Different Affinities", Virology, 2001; 280(1):7-18. doi:10.1006/viro.2000.0747.

Dean et al., "Nuclear Entry of Nonviral Vecotors", Gene Ther. Jun. 2005; 12(11): 881-890, doi: 10.1038/sj.gt.3302534.

Dine et al., "Immune Checkpoint Inhibitors: An Innovation in Immunotherapy for the Treatment and Management of Patients with Canter", Asia Pac J Oncology Nursing, Apr.-Jun. 2017; vol. 4(2): 127-135. doi: 10.4103/apjon.apjon_4_17.

Dou D, et al., "Influenza A Virus Cell Entry, Replication, Virion Assembly and Movement", Frontiers in Immunology, Jul. 20, 2018; 9:1581. doi:10.3389/fimmu.2018.01581.

Edlefsen PT., "Leaky Vaccines Protect Highly Exposed Recipients at a Lower Rate: Implications for Vaccine Efficacy Estimation and Sieve Analysis", Computational and Mathematical Methods in Medicine, May 2014: 813789. doi:10.1155/2014/81378.

Eisenberg et al., "Herpes Virus Fusion and Entry: A Story with Many Characters", Viruses 2012; 4(5):800-832. doi:10.3390/v4050800.

Ei Osta et al., "Not All immune-Checkpoint Inhibitors are Created Equal: Meta Analysis and Systematic Review of Immune-Related Adverse Events in Cancer Trials", Critical Reviews in Oncology / Hematology, Nov. 2017; 119:1-12. doi: 10.1016/j.critrevonc.2017.09.002.

Gilbert, Sarah, "T-Cell-inducing Vaccines—What's the Future", Immunology The Journal of Cells, molecules, Systems and Technologies, Jan. 2012; 135(1): 19-26. doi: 10.1111/j.1365-2567.2011.03517.x.

Hayden, Erika, "Misleading Mouse Studies Waste Medical Resources", Mar. 26, 2014, Nature News (available at https://www.nature.com/news/misleading-mouse-studies-waste-medical-resources-1.14938).

Hensel et al., "Prophylactic Herpes Simplex Virus 2 (HSV-2) Vaccines Adjuvanted with Stable Emulsion and Toll-Like Receptor 9 Agonist Induce a Robust HSV-2-Specific Cell-Medicated Immune Response, Protect against Symptomatic Disease, and Reduce the Latent Viral Reservoir", Journal of Virology, American Society for Microbiology, May 2017, 91(9) e02257-16; DOI: 10.1128/JVI.02257-16.

Hernáez B, et al., "African Swine Fever Virus Undergoes Outer Envelope Disruption, Capsid Disassembly and Inner Envelope Fusion before Core Release from Multivesicular Endosomes", PLOS Pathogens, 2016;12(4):e1005595. Published Apr. 25, 2016. doi:10.1371/journal.ppat.1005595).

Hobernik, et al., "DNA Vaccines—How Far From Clinical Use?", International Journal of Molecular Sciences, Nov. 2018; 19(11): 3605 (doi: 10.3390/ijms19113605).

Hollingsworth et al., "Turning the Corner on Therapeutic Cancer Vaccines", NPJ Vaccines, 2019; 4:7. doi:10.1038/s41541-019-0103-y.

Jang et al., "A Segment of the 5' Nontranslated Region of Encephalomyocarditis Virus RNA Directs Internal Entry of Ribosomes During In Vitro Translation", Journal of Virology, Aug. 1988; 62(8):2636-43.

Kim et al., "The Life Cycle of a T Cell After Vaccination—Where Does Immune Ageing Strike?", Clinical & Experimental Immunology, The Journal of Translational Immunology, Clin Exp Immunol. Jan. 2017; 187(1): 71-81. doi: 10.1111/cei.12829.

Kim et al., "High Cleavage Efficiency of a 2A Peptide Dervied from Porcine Teschovirus-1 in Human Cell Lines, Zebrafish and Mice", PLoS One, Apr. 2011; vol. 6, Issue (4):e18556. doi: 10.1371/journal.pone.0018556. Epub Apr. 29, 2011.

Kurupati et al., "Safety and Immunogenicity of a Potential Checkpoint Blockade Vaccine for Canine Melanoma", Cancer Immunology, Immunotherapy, Dec. 6, 2017 Oct; 67(10):1533-1544. doi: 10.1007/s00262-018-2201-5.

Lasaro, et al., "Potentiating Vaccine Immunogenicity by Manipulating the HVEM/BTLA Pathway and Other Co-Stimulatroy and Co-Inhibitory Signals of the Immune System", Human Vaccines, 5:1, 6-14, Jan. 1, 2009. DOI:10.4161/hv.5.1.6399 (2009).

Lasaro et al., "Anit-tumor DNA Vaccines Based on the Expressionof Human Papillomavirus-16 E6/E7 Oncoproteins Genetically Fused with Glycoprotein D from Herepes Simplex Virus-1", Microbes and Infection 7 (2005) 1541-1550.

Lasaro et al., "Targeting of Antigen to the Herpesvirus Entry Mediator Augments Primary Adaptive Immunce Respones", Nature Medicine. vol. 14(2): 205 (Feb. 2008).

Li, et al., "Molecular Mechanisms for Enhanced DNA Vaccine Immulogenicity", Expert Rev Vaccines, 2016; 15(3):313-29. doi: 10.1586/14760584.2016.1124762.

Mak et al., "Lost in Translation: Animal Models and Clinical Trials in Cancer Treatment", Am J Transl Res. 2014; 6(2):114-118.

Menotti et al, "Construction of a Fully Retargeted Herpes Simplex Virus 1 Recombinant Capable of Entering Cells Solely via Human Epidermal Growth Factor Receptor", Journal of Virology. Oct. 2008. vol. 82, No. 20, p. 10153-10161.

Milne, et al., "Porcine HveC, A Member of the Highly Conserved HveC/Nectin 1 Family, Is a Functional Alphaherpesvirus Receptor", Virology. 2001; 281(2):315-328. doi:10.1006/viro.2000.0798.

Pangioti et al., "Features of Effective T-Cell-Inducing Vaccines Against Chronic Viral Infections", Front. Immunol., Feb. 16, 2018. https://doi.org/10.3389/fimmu.2018.00276.

Pelletier et al., "Internal Initiation of Translationof Eukaryotic mRNA Directed by a Sequence Derived from Poliovirus RNA", Nature vol. 334, Jul. 28, 1988 (6180):320-5.

Pennock, et al., "T Cell Vaccinology: Beyond the Reflection of Infectious Responses", Trends in Immunology. vol. 37, ISS. 3, p. 170-180, Mar. 2016. DOI: 10.1016/j.it.2016.01.001.

Ramachandran, et al., "The Cancer-Immunity Cycle as Rational Design for Synthetic Cancer Drugs: Novel DC vaccines and CAR T-cells", Seminars in Cancer Biology 45 (2017) 23-35. doi:10.1016/j.semcancer.2017.02.010.

Santana et al., "Biscistronic DNA Vaccines Simultaneously Encoding HIV, HSV and HPV Antigens Promote CD8+ T Cell Responses and Protective Immunity", PLoS One 8(8): e71322. doi:10.1371/journal.pone.0071322 (2013).

Sondak, et al., "Allogeneic and Autologous Melanoma Vaccines: Where Have We Been and Where are We Going?" Clin Cancer Res. 2006; 12(7 Pt 2):2337s-2341s. doi:10.1158/1078-0432.CCR-05-2555.

Zhang, et al., "The Effect of Adjuvanting Cancer Vaccines with Herpes Simplex Virus Glycoprotein D on Melanoma-Driven CD8+ T Cell Exhaustion", The Journal of Immunology, 2014; 193: 1836-1846.

Zhou, et al., "Separation of Receptor-Binding and Profusogenic Domains of Glycoprotein D of Herpes Simplex Virus 1 into Distince Interacting Proteins", Mar. 6, 2007. Proc. Natl. Acad. Sci. U. S. A., vol. 104, No. 10. 104:4142-4146. 10.1073/pnas.0611565104.

Zhou, et al., "Engineered Herpes Simplex Virus 1 in Depsendenet on the IL13R2 Receptor for Cell Entry and Independent of Glycopretien

(56) References Cited

OTHER PUBLICATIONS

D Receptor Interaction", 2002. Proc. Natl. Acad. Sci. U. S. A., col. 99, No. 23. 99:15124-15129. 10.1073/pnas.232588699.

Aldhamen, el al., "CRACC-Targeting Fc-Fusion Protein Induces Actiivation of NK Cells and Dcs and Improves T Cell Immune Respones to Antigenic Targets", Vaccine 34 (2016) (27):3109-3118. doi:10.1016/j.vaccine.2016.04.068.

Aldhamen, et al., "Vaccines Ecpressing the Innate Immune Modulator EAT-2 Elicit Potent Effector Memory T Lymphocyte Respones Despite Pre-Existing Vaccine Immunity", Journal of Immunology, 2012; 189(3): 1349-1359. doi:10.4049/jimmunol.1200736.

Aldhamen, et al., "Expression of the SLAM Family of Receptors Adapter EAT-2 as a Novel Strategy for Enhanging Beneficial Immune Responses to Vaccine Antigens", Journal of Immunology, 2011; 186(2): 722-732. doi:10.4049/iimmunol.1002105.

Aldhamen, et al., "Improved Cytrotoxic T-Lymphocyte Immune Responses to a Tumor Antigen by Vaccines Co-Expressing the SLAM-Associated Adaptor EAT-2", National Institute of Health, Cancer Gene Therapy., Oct. 2013, 20(10); 564-575.

Aldhamen, et al., "Manipulation of EAT-2 Expression Promotes Induction of Multiple Beneficial Regulatory and Effector Functions of the Human Innate Immune Systems as a Novel Immunomodulatory Strategy", International Immunology, vol. 46, No. 5, pp. 291-303.

Pérez-Quintero LA et al., EAT-2, a SAP-like Adaptor, Controls NK Cell Activation Through Phospholipase Cγ, Ca++, and Erk, Leading to Granule Polarization, The Journal of Experimental Medicine, 2-14, 211(4):727-742 J Exp Med. 2014;211(4):727-742. doi:10.1084/jem.20132038.

Ahrends et al., "CD4+ T cell help creates memory CD8+ T cells with innate and help-independent recall capacities". Nature Communications. (2019)10:5531.

ALPHAHERPESVIRUS GLYCOPROTEIN D-ENCODING NUCLEIC ACID CONSTRUCTS AND METHODS

CROSS-REFERENCE TO RELATED APPLICATIONS (PRIORITY)

This application claims the benefit of U.S. Provisional Application No. 63/038,117, titled "IMPROVED ALPHAHERPESVIRUS GLYCOPROTEIN D-ENCODING NUCLEIC ACID CONSTRUCTS AND METHODS", filed Jun. 11, 2020.

REFERENCE TO SEQUENCE LISTING SUBMITTED ELECTRONICALLY

The content of the electronically submitted sequence listing in ASCII text file with the following identifiers: Name: "210513_SEQLST_FINAL_gD_MBF2024USMBZ_ST25"; Size: 1,517 kilobytes (1,517,000 bytes); and Date of Creation: May 13, 2021, filed on May 17, 2021, is incorporated herein by reference in its entirety.

BACKGROUND OF THE INVENTION

Despite now well over 100 years of immunological research, and more recently the development of advanced biotechnological approaches to modulating the immune system, immunological diseases and conditions remain a significant challenge in both humans and non-human animal populations.

The oldest and most applied application of immune system modulation is the administration of vaccines derived from pathogens. Numerous approaches to vaccination are known in the art. In general, all vaccination methods rely on the introduction of an antigen, typically as a peptide/protein or collection of peptides/proteins associated with a disease-causing agent, which elicits an immunological response, such as the production of antibodies from antibody-producing B cells (which is also known as humoral immune response). Such methods have been enhanced by methods for optimizing antigen selection and dosing and through the associated use of adjuvants (substances that enhance the immune response to an antigen). Examples of well-characterized and frequently used adjuvants include mineral salts (e.g., aluminum salts), oil emulsions, microbial polysaccharides, and saponins. More recently, many cytokines that promote immune system activity have been isolated and characterized which can also act as adjuvants (e.g., interferons and interleukins). Synthetic antigens also are known.

The administration of vaccines, resulting in prevention of infection by or protection against disease-causing agents, is also sometimes referred to as "immunization." However, it is important to understand that immune system modulation can be prophylactic, as in the case of vaccines, or therapeutic (immunotherapy). Therapeutic immunization—treatment of patients that already have a disease that may be regulated through the immune system, e.g., cancer, chronic viral infections—is one distinguishing aspect of the newer field of immunotherapy (over traditional vaccination).

Vaccines have been effective against a number of pathogenic conditions, and the promise of immune system modulation has fueled research into finding more effective antigens against diseases that impact people and animals. Scientists have now characterized and described numerous antigens for clinical use as peptide/protein vaccines, especially among better studied disease-causing agents. Prophylactic vaccines against a number of disease-causing agents are currently on the market, including vaccines against Chickenpox (Varicella), Cholera, Diphtheria, Flu (Influenza), Hepatitis A, Hepatitis B, Hib (Hemophilus Influenzae Type B), HPV (Human Papillomavirus), Japanese Encephalitis (JE), Measles, Meningococcal, Mumps, Pneumococcal, Polio, Rabies, Rotavirus, Rubella (German Measles), Shingles (Herpes Zoster), Tetanus (Lockjaw), and Typhoid Fever, Porcine Respiratory and Reproductive Virus, Porcine Circovirus, Canine Influenza, Canine Parvovirus, Newcastle Virus, and Bovine Diarrheal Virus, among others. The promise of vaccination also has led to significant research focused on the characterization of antigens and associated immune responses in both pathogenic diseases and cancer. Specific well-characterized antigens that have been repeatedly studied for development of immune responses include the Hepatitis B Surface Antigen (HBsAg), Hepatitis B Core Antigen (HBcAg), Hepatitis C Virus core antigen (HCVcAg), HIV glycoprotein (gp)120, Herpes Virus Glycoprotein B (gB), and various forms of alphaherpesvirus Glycoprotein D (gD).

Despite such research, many vaccination approaches, while initially successful, are not sufficiently protective against later challenge with the same pathogen. The immune system's ability to more rapidly respond to antigens similar to those a subject has been exposed to in the past is known as "immunological memory." Immunologists often characterize vaccination approaches that result in an immune response that is only partially effective against subsequent challenges as "leaky vaccines." (SFE Edlefsen P T. Comput Math Methods Med. 2014.) The "leaky" characterization of such vaccines reflects that while such vaccines can elicit an immune response to a subsequent challenge with a related antigen-associated agent, the response is not sustaining or complete (sterilizing), and, thus, typically also is not sufficient to adequately block disease or spread of the disease in the population. Panagioti et al. similarly report "After resolution of the infection, the majority (90-95%) of the effector T cells are eliminated due to programmed cell death and only a small, yet diverse pool of memory cells remains," Front. Immunol., 16 Feb. 2018, reflecting the fact that many current vaccines are not capable of creating protective immunological memory.

Possibly because of these and similar shortcomings, many diseases have been studied for vaccine development but without established clinical success to date, such as Dengue, *Helicobacter pylori*, and Malaria. Further, even on-market vaccines can have limited efficacy, especially in certain populations such as those with challenged or deficient immune systems or the elderly. According to Kim et al., Clin Exp Immunol. 2017 January; 187(1): 71-81, for example, although influenza vaccination has rapidly increased, the "burden of mortality and morbidity linked to influenza infection in the older population remains high," with effectiveness of the vaccine estimated to be as low as 30%. Kim et al. reports that similar declining efficacies occur with vaccination with the attenuated varicella zoster virus (VZV), declining from 70% for 50-59-year-old adults to 38% for adults aged 70 years and older.

With better research it is now understood that many viruses enter host cells within minutes of infection where they are immediately sequestered from contact with B cells and free to proliferate and release virus progeny into circulation. For example, African Swine Fever Virus enters host cells within 10 minutes of infection (SFE Hernáez B, Guerra M, Salas M L, Andres G. PLoS Pathog. 2016; 12(4)) and influenza virus enters/fuses with host cells in approximately 10 minutes and is inside the nucleus in approximately 1 hour (Dou D et al. Front Immunol. 2018; 9:1581). Thus, such pathogens can evade protection through humoral immunity-focused approaches.

Over recent decades the ability to effectively modulate the immune system has increased with breakthroughs in the fields of understanding both "cellular" (T cell-mediated) immunity as a key part (along with B cells) of "adaptive immunity" and "innate immunity", as well as the understanding that certain disease-associated agents (e.g., cancer cells and some chronically infected cells) are able to evade the body's normal immunological responses through modulation of checkpoint systems.

The innate and adaptive immune systems have been extensively characterized in the art. Briefly, the innate immune system includes physical barriers such as skin and mucosa; physical responses such as tears, stomach acids, and the cough reflex; and a number of specialized cells, particularly phagocytes, including monocytes, macrophages, and neutrophils. One recent useful overview of the relationship between various cells of the immune system is provided in Lasaro et al., Human Vaccines, 5:1, 6-14 (2009), but others are available.

Natural killer ("NK") cells (or NKC) and dendritic cells ("DCs") have traditionally also been characterized as innate immune cells. However, such cells also are now understood to reflect characteristics of adaptive immunity and to play key roles in the interplay between innate immunity and classical adaptive immunity. For example, it has been demonstrated that NK cells also can exhibit immunological memory and a body of research is demonstrating that the innate immune responses can contribute significantly to immunity in certain contexts, though these principles still often remain poorly understood. Dendritic cells which are both considered a key link between innate and natural immunity and a key antigen presenting cell ("APC") have been the focus of extensive research and development in connection with the treatment of immunologically mediated diseases and conditions. In 2010, the US FDA approved the first DC-based immunotherapy (Provenge®) for patients with advanced prostate cancers. However, thus far only a few DC-based treatment strategies have been tested for viral conditions in clinical trials. Efficacy in many trials targeting dendritic cells to date has been, "at best, mixed, and in many cases little efficacy has been demonstrated with such approaches, particularly with respect to reductions in viral load" and "the immunological responses [in such trials] were either weak or transient and, more importantly, reduction in viral load has been observed in only a few of these studies." Atanley E et al. Expert Rev Clin Immunol. 2014; 10(6):801-813. Other recent research has demonstrated that DCs are often ineffective at antigen presentation because of suboptimal levels of major histocompatibility complex (MHC) class II and low levels of co-stimulator molecules as well as adhesion molecules, necessary for the effective interaction of DCs with other key immune system cells, such as T cells. See Chen P, et al. Hum Vaccin Immunother. 2016; 12(3):612-622.

Despite these advances, most available vaccines remain directed to generating B cell responses. However, recent research indicates that T cell immunity appears particularly relevant to certain conditions, such as some viral infections, in particular chronic infections (vs. self-limiting conditions), and cancer. SFE Pangioti et al, supra. However, the number of effector cells required for an effective T cell response are "exponentially larger" than the number of cells required for an effective B cell response. SFE Pennock et al., Trends in Immunology. Vol. 37, ISS. 3, p 170-180, March 2016. As such, most modern adjuvants and formulations can produce the required number of effectors for effective B cell immunity, but not for T cell immunity. Id. Moreover, the magnitude of viral-specific T cell responses is highly dictated by the infectious dose and route of infection, with higher infectious dosages leading generally to higher peak values of effector T cells, and correspondingly larger amounts of memory T cells in the circulation being found in such a situation, contributing to immunological memory. SFE Pangioti et al, supra. However, if the immune system is overwhelmed and virus replication remains at a high level, this eventually leads to exhaustion of T cells and poor memory formation. Id. These and other insights are leading to a variety of different strategies for improving T cell-directed treatments, but many of these efforts are still in early stages. Id.

Still another challenge is the nature of the T cell response that is induced by a vaccine or immunotherapy. Until recently, it was believed that induction of CD8+ cytotoxic T lymphocytes was sufficient to provide protective memory in immunized animals, however, recent work suggests that CD4+ memory T cells may play an important role in such processes. (Zander et al. 2019; Ahrends et al. 2019).

One new immunotherapy approach directed to overcoming such issues is the use of autologous vaccines; however, such methods are very expensive, such that the perceived return on investment of such approaches is low, and treatment may be prohibitively expensive in many contexts, such as in the immunization of non-human animals. Obtaining sufficient samples for effective autologous treatment is also a significant limitation (SFE Sondak V K et al. Clin Cancer Res. 2006; 12(7 Pt 2):2337s-2341s), and even overcoming such issues there has been very limited success to date with such approaches (SFE Hollingsworth et al. NPJ Vaccines. 2019; 4:7).

Another approach that has received significant recent attention as a potential improvement over traditional vaccines is CAR-T therapy. However, practical applications of such therapies, while promising, also appear to remain limited to blood cancers (SFE Ramachandran M. et al. Semin Cancer Biol. 2017; 45:23-35), and the technology is both very complex and very expensive, making it likely impractical for widespread application or application in the treatment of non-human animals.

Still another potentially significant breakthrough over the last few decades has been the development of recombinant "nucleic acid vaccines," which typically are in the form of viruses or plasmids containing nucleic acid sequences encoding for one or more antigens. However, despite a huge number of disclosures in patent documents, and several actual clinical trials, to date no DNA vaccines have been approved for human use and only two have been approved for veterinary use (protection against West Nile Virus in horses and treatment of canine melanoma) (Hobernik and Bros, "DNA Vaccines-How Far From Clinical Use?", Int J Mol Sci. 2018 November; 19(11): 3605). Hobernik and Bros indicate that the impeded development of DNA vaccine approaches to immunotherapy appears to be attributable to the fact that while nucleic acid vaccines known to date have been able to evoke detectable levels of cellular and humoral responses in the clinic, such responses have not been sufficient to elicit actual clinical benefits. In Manickan et al., "DNA Vaccines—A Modern Gimmick or a Boon to Vaccinology?", Crit Rev Immunol. 2017; 37(2-6):483-498, the authors, after reviewing uses of DNA vaccines since 1993, similarly question the efficacy of DNA vaccines, concluding "It seems doubtful if DNA vaccines will replace currently effective vaccines . . . "

Given these facts, in recent years there has been a significant focus on "DNA vaccine optimization strategies." As summarized by Hobernik and Bros, these numerous approaches to improve DNA vaccines focus on optimization of promoters, optimization of antigens (e.g., codon optimization), inclusion of amino acid sequences that stimulate the immune system (e.g., A/T-rich sequences, CpG oligonucleotide sequences); and co-administration with various adjuvants (e.g., cytokines) or enhancers (e.g., signaling adaptors and/or transcription factors). Li and Petrovsky, review a similar list of strategies under research for potentially improving the efficacy of DNA vaccines which include use of novel plasmid vectors, codon optimization to enhance antigen expression, new gene transfection systems or electroporation to increase delivery efficiency, use of protein or live virus vector boosting regimens to maximize immune stimulation, and formulation of DNA vaccines with traditional or molecular adjuvants. Expert Rev Vaccines. 2016; 15(3):313-29.

Specific examples of such improvements include use of hybrid viral/eukaryotic promoters; use of expression systems optimized for antigen-presenting cell ("APC") expression; use of codon optimization; use of linkers to separate antigens; use of nuclear localization signals (NLSs) to facilitate nuclear entry of the DNA (SFE Dean et al., Gene Ther. 2005 June; 12(11): 881-890, and Bai et al., Biosci Rep. 2017 Dec. 22; 37(6): BSR20160616); fusion protein constructs with a MHC Class II invariant chain sequence; co-administration of expression vectors encoding factors that enhance APC activation and/or T cell attraction/polarization; inclusion of intrinsic inhibitory elements (e.g., insertion of A/T-rich sequences), and inclusion of additional adjuvant (e.g., cytokine); or secondary sequences encoding such factors, which often are designed as a polycistronic construct by incorporation of polycistronic-enabling factors, such as an IRES (internal ribosome entry site) sequence and/or 2A self-cleaving peptide sequence (e.g., P2A, T2A, E2A, or F2A) (SFE Pelletier et al, Nature. 1988 Jul. 28; 334(6180):320-5, Jang et al. J Virol. 1988 August; 62(8): 2636-43, Ibrahimi et al., Hum Gene Ther. 2009 August; 20(8):845-60; and Kim et al., PLoS One. 2011; 6(4):e18556; Epub 2011 Apr. 29). Understanding that antigens are processed in antigen-presenting cells ("APCs") in the proteasome, one approach that has been proposed is to use proteasome-targeting sequences (e.g., ubiquitin "tags") to direct antigen/tag "fusion" proteins/peptides expressed from nucleic acid vaccines (SFE US Patent Publication No. US20020058021). However, no single approach appears to have overcome the shortcomings associated with $1^{st}$ generation DNA vaccines.

Another recent relevant insight concerning the effectiveness of immunotherapy and vaccination is that checkpoint inhibition may have been the cause of at least some of the clinical ineffectiveness of T cell-directed vaccines for cancer and viruses developed in the 1990s and 2000s. Understanding checkpoint regulation of the immune system has led to the development of new classes of products (e.g., modulators of CTLA4, PD-1, and PD-L1), particularly in the treatment of cancer (SFE Naidoo et al., Hematol Oncol Clin North Am. 2014 June; 28(3):585-600, Haanen and Robert, Prog Tumor Res. 2015; 42:55-66; Epub 2015 Sep. 4, and Dine et al., Asia Pac J Oncol Nurs. 2017 April-June; 4(2): 127-135, each discussing early checkpoint inhibitor breakthroughs, and Kourie et al., Immunotherapy. 2017 June; 9(8):647-657, discussing new areas of checkpoint inhibition research and development). However, while checkpoint blockade is universally effective against a broad spectrum of cancer types and is mostly unrestricted by the mutation status of certain genes, only a minority of patients achieve a complete response. SFE Li et al., Curr Med Chem. 2019; 26(17):3009-3025. All checkpoint inhibitors used in human therapy to date are monoclonal antibodies. Also, different checkpoint inhibitors exhibit markedly different physiological effects, and most major checkpoint inhibitors are associated with relatively high levels of immunological adverse events. El Osta et al., Crit Rev Oncol Hematol. 2017 November; 119:1-12.

Recently several patent publications have reported on combinations of checkpoint inhibitors, antigens, and immunostimulators to design more effective immunostimulators. WO2017177907, for example, describes recombinant proteins comprising an immune checkpoint molecule segment, an auxiliary T cell epitope segment, and an immunostimulatory molecule segment. U.S. Pat. No. 9,474,717 is directed to DNA constructs, delivered with calcium phosphate nanoparticles, comprising an immunomodulatory element, such as a checkpoint inhibitor (e.g., PDL1), which is sometimes combined in disclosed embodiments with targeting or immunostimulatory elements. WO2018140890 similarly discloses nucleic acid constructs encoding a checkpoint inhibitor (e.g., PD-L1, PD-L2), targeting factors, immunomodulatory elements (e.g., cytokines), and antigens. WO2019071032 similar discloses nucleic acid constructs comprising checkpoint inhibitor sequences, immunomodulatory sequences, targeting factors, and multiple antigen-encoding sequences.

As noted above, herpes glycoprotein D (gD) proteins have been a target of study in vaccine development (where gD is used as an antigen), including more recently in the context of DNA vaccines. However, many gD vaccines also have been ineffective (one recent report indicating that the use of CpG oligonucleotide adjuvants may address previous failings of gD vaccines. Hensel et al., Journal of Virology April 2017, 91 (9) e02257-16). U.S. Pat. No. 9,795,658 teaches a different approach to improve gD immunogenicity by introducing stabilizing agents into DNA vaccines encoding gD proteins, such as PEST sequences (short half-lived sequences rich in proline, glutamic acid, serine and threonine, optionally flanked by amino acids comprising electropositive side chains) or ubiquitin sequences. Australian Patent Application AU2005202233 and US Pat. Pub. No. 2002/0058021 teach a different approach, in which gD, gB, or gC-encoding sequences are combined with rabbit intron sequences and a tPA signal sequence in a DNA vaccine in which gD is used as an antigen for treatment of pets and other animals.

Glycoprotein D is an envelope glycoprotein found on Herpes simplex viruses such as HSV-1 or HSV-2 and is expressed in cells infected by the viruses. Glycoprotein D also is a receptor-binding glycoprotein of herpesviruses. In general, the gD ectodomain is organized in two structurally and functionally differentiated regions. The amino-terminus includes the signal sequence and receptor-binding sites, and the carboxy-terminus includes the pro-fusion domain and the transmembrane domain. HSV-1 gD interacts with two primary receptors belonging to unrelated protein families, the Herpes Virus Entry Mediator (HVEM—aka, HveA, TNFR14) and nectin-1 (aka, HveC).

Structurally, HSV-1 gD contains a core domain with a variable-type immunoglobulin fold (IgV, residues 55 to 185). HSV-1 gD also has an estimated 23-to-25-amino acid amino-terminal signal sequence and a carboxy-terminal transmembrane domain. The signal sequence is typically cleaved in the mature form of the protein. An N-terminal flexible region, located at residues 26-46, forms a hairpin structure that binds HVEM. The C-terminal end of the protein, residues 255-394 appears to be involved with viral cellular entry, and residues 255-340 are also flexible in nature. The area defined by about residues 360-310 is considered the profusion domain (PFD), which is required for viral infectivity and fusion but not for receptor binding. A transmembrane domain is located around residues 341-361/363 and a topological domain is located from residues 362-394. HSV-1 gD also comprises a number of N-linked glycosylation sites (e.g., at residues 119, 146, and 287) and two other O-linked glycosylation sites. HSV-1 gD and other gD proteins, such as PRV gD, comprise three internal cysteine-cysteine (cys-cys) disulfide bonds (in HSV-1 these are located between residues 91-214, 131-227, and 143-152).

Other HSV gD homologs have been identified in numerous alphaherpesviruses including Marek's Disease Virus (MDV) gD (also known as Gallid alphaherpesvirus 2 (GaHV-2), which infects chickens; pseudorabies virus (PRV), which infects swine; bovine herpesvirus glycoprotein D; canine herpesvirus gD; and equine herpesvirus gD, among others. Although level of sequence identity between such homologs are relatively low (e.g., about 23%), there are overlaps in function between members of this protein family, even from different viruses, including competition for the same receptors (e.g., nectin-1). SFE Connolly S A, Whitbeck J J, Rux A H, et al. Glycoprotein D homologs in herpes simplex virus type 1, pseudorabies virus, and bovine herpes virus type 1 bind directly to human HveC (nectin-1) with different affinities. Virology. 2001; 280(1):7-18. Even among alphaherpesviruses that infect the same species there are significant differences in terms of sequence identity, suggesting that even sequences with differences in composition may retain/exhibit somewhat similar functioning. For example, HSV-2 gD exhibits more than 65% amino acid sequence identity to HSV-1 gD and is generally structurally similar to HSV-1 gD, despite having an ectodomain that is shorter by one residue and binding affinity for nectin-2 (HVeB). There are similar levels of compositional differences between sequences of bovine herpesvirus gD proteins.

Researchers from the Wistar Institute have previously invented, researched, and published extensively on nucleic acid constructs that use gD/antigen fusion proteins as a vehicle for antigen delivery (see, U.S. Pat. No. 8,962,816 ("the '816 patent"), which resulted from International Patent Application WO/2008/027394, which was published in June of 2008, which claims priority to a provisional application filed in 2006). Expression of nucleotide sequence constructs described in the '816 patent reportedly results in one or more antigens being contained in a fusion protein containing an antigenic sequence inserted into the C-terminus (most broadly between residues 230-300) of a full length, truncated, or modified (mutated) gD protein which retains the ability to interact with HVEM and possibly exhibit other gD functions (SFE col. 8, lines 59-67) (alphaherpesvirus gD proteins are known to bind several other receptors across several species and even operate differently in different cell/tissue types (SFE Milne et al., Virology. 2001; 281(2): 315-328), although cross-species binding is reduced or sometimes non-existent and binding does not always lead to viral-cell fusion (Id. and see also, e.g., Connolly et al., Virology. 2001; 280(1):7-18, Eisenberg et al., Viruses. 2012; 4(5):800-832 and Menotti et al, Virology. 2001; 282(2):256-266.). Unlike vaccine approaches, however, the '816 patent highlights the importance of the gD protein to interact with the HVEM cell receptor and to disrupt the HVEM-BTLA pathway, and thus act as a checkpoint inhibitor. The '816 patent specifies that the antigenic sequence of such a construct is fused directly to an N-terminal gD amino acid and also to a C-terminal gD amino acid (SFE col. 8, lines 11-25) and the experimental data reported in the '816 patent indicates that the inventors perceived this configuration of the fusion protein to be important to the relatively enhanced immunogenic properties of such proteins as compared to corresponding antigen-only constructs.

Although the '816 patent makes some reference to a variety of possible antigens that can be contained in such a gD fusion protein-expressing construct, the '816 specifically exemplifies the use of only two types of gD fusion proteins. The first construct comprised an HIV gag antigen embedded within the gD sequence. The second construct comprised an antigenic sequence that comprised a combination of apparently directly fused HPV E5/E6/E7 oncoproteins or just the E7 oncoprotein. A third construct, at least designed to express a GD fusion protein comprising Thrombospondin-related anonymous protein (TRAP) "from parasite *Plasmodium falciparum* and Myco bacterium tuberculosis epitope string (TB) without their start and stop codons are incorporated into the HSV-1 gD NarI site, which corresponds to amino acid 288 in the gD mature form," was specifically described, but not tested.

The two above-described tested constructs of the '816 patent were administered to cells and animals as both plasmid and adenoviral constructs. While both types of vectors were sometimes able to induce an immune response (including a memory immune response lasting at least one year), the adenoviral vector constructs outperformed the plasmid vectors in most cases; in some cases the plasmids were deemed non-immunogenic (SFE col. 34, lines 19-23); and the researchers ultimately appear to have envisioned that adenoviral vectors would be a required part of a clinical trial program (albeit possibly aided by initial plasmid immunization, a course that does not appear to have been employed in later related work).

The experiments reported in the '816 patent reflect that T cell responses were induced by these constructs in a variety of different models and that, at least in some cases, measurable B cell (humoral) responses could also be induced for at least some of these constructs (e.g., vectors expressing the gD-gag fusion protein (SFE Example 9)). Some of the gD fusion protein constructs described in the '816 patent, however, did not result in a measurably enhanced immune response when tested (SFE Example 10), indicating that the specific gD/antigen/vector combination may be determinative of clinical efficacy, though the amount of guidance the '816 patent provides on this point is limited. As such, while the '816 patent demonstrated that gD fusion proteins can sometimes aid in inducing a B cell or T cell immune response to an incorporated antigen, the successful application of such a strategy to any particular gD:fusion protein context will continue to require ingenuity. Furthermore, no effort was made to measure innate immune responses, however, or to include separate sequences for simultaneous induction of different arms of the immune system in the '816 patent.

Both around the time that the priority application for the '816 patent was filed and thereafter, the named inventors of the '816 patent (Hildegund Ertl, Marcio O. Lasaro, and Luis Ferreira) authored several published papers detailing experiments either corresponding to or similarly including gD fusion protein-expressing nucleic acid constructs (either as DNA vaccines or adenoviral vectors) containing multiple HIV or HPV antigens, usually involving 2-4 dosages of such constructs and corresponding measurements of T cell or both T cell and B cell responses in mice, typically reflecting improved immune responses, which the researchers consistently attribute to gD:HVEM binding and to placement of antigens within gD as described in the '816 patents. SFE Lasaro et al., Microbes and Infection 7 (2005) 1541-1550 and Lasaro et al., Nature Medicine. Vol. 14(2): 205 (2008); and Lasaro et al. (2009), supra.

An extension of this work described in Santana et al., PLoS ONE 8(8): e71322 (2013), reviewed the use of bicistronic plasmid vectors encoding two different gD fusion proteins with antigens from HPV, HIV, and Herpes Simplex Virus (HSV), with 20% of mice treated with one such vector remaining tumor free and 60% developing a therapeutic response against transplanted tumor cells. The authors noted that the multi-cistron approach led to a more balanced and efficient T cell response, but that there may have been differential expression from the two cistron construct of the different fusion proteins. The authors also emphasized the perceived importance of gD membrane localization to such T cell effects.

In 2014 Dr. Ertl and colleagues published a paper detailing experiments involving the initial and booster administration of gD fusion protein-expressing adenoviral vector constructs comprising the Epstein-Barr virus nuclear antigen 1 (EBNA-1) in Rhesus Macaques. Although the researchers saw a marked increase in EBNA-1 specific CD8 and CD4 cells receiving the gD:EBNA-1 fusion protein-expressing construct, the differences in animals receiving the fusion protein treatment versus just the antigen were "too subtle to clearly demonstrate an effect of HSV gD," despite the previously obtained results with different constructs in mice. While the researchers also did not detect a difference in T cell response between animals administered a HVEM-binding vs. non-HVEM-binding form of gD, also contradicting early work with gD fusion protein-expressing constructs, the authors nonetheless noted that "only animals that received the vaccine with [HVEM] binding gD developed increased CD8EM responses that were significantly larger" than responses with an unrelated antigen-only administration.

In additional follow-on research conducted by Dr. Ertl, a nucleic acid sequence encoding a combination antigen named "Melapoly" (comprising unspecified spacer-separated sequences of CD4+ and CD8+ T cell epitopes of melanoma-associated Ags (MAAs) including tyrosinase-related protein (Trp)-1, Trp-2, gp100, and mutated BrafV600E linked to the universal TH cell epitope PADRE, and an endoplasmic reticulum ("ER") targeting signal sequence) was inserted into a gD-encoding sequence in the manner of the '816 patent constructs, and the sequence was delivered to and expressed in animals in a mouse melanoma model via chimpanzee adenoviral vectors similar to those used in the '816 patent (Zhang Y and Ertl C J (2014). The Effect of Adjuvanting Cancer Vaccines with Herpes Simplex Virus Glycoprotein D on Melanoma-Driven CD8+ T Cell Exhaustion. J. Immunol. 193(4): 1836-46). This research found that the gD-Melapoly fusion protein was able to induce T cell immune responses, however the response was not always clearly stronger than that achieved with immunization of antigen alone. What the researchers noted, however, was that the results of the reported experiments indicated that such a gD-T cell antigen construct might be capable of inducing a more effective T cell response in animals under a condition of T cell exhaustion, which results from continued antigen stimulation of T cells in chronic viral diseases (e.g., lymphocytic choriomeningitis virus, HIV, and HCV infection) or related ("subsequent") cancers. The authors also highlighted the focus of these products on stimulating only CD8+ T cells as an advantage of such GD fusion protein constructs (see p. 1845, right col., second full paragraph).

Experiments involving gD:Melapoly-expressing adenovirus nucleic acid constructs are also described in U.S. Pat. No. 9,744,424 (to Ertl and Zhang). The '424 patent further discloses the combined uses of adenoviral vectors of gd:Melapoly-encoding adenoviral vectors with fibroblast activation protein ("FAP")-encoding adenoviral vectors, either concurrently or in a prime boost administration strategy. The '424 patent provides structural information relating to the Melapoly multi-antigen sequence, reflecting that it contains three CD4+ T cell epitopes and eight CD8+ T cell epitopes from four melanoma associated antigens (see Cols. 21-22) separated by unspecified "conventional linker sequences" (presumably alanine-alanine spacer sequences). While significantly enhanced CD8+ T cell responses were reported to be induced in mouse tumor model animals treated with the gD:Melapoly-expressing adenoviral vectors, the composition failed to cure mice completely, especially in mice with advanced tumors (see col. 24, lines 15-22). Results were improved when the two different adenoviral vectors were co-administered. The addition of the FAP-expressing vector appears to have resulted in detection of T cells to FAP epitopes, a significant increase in certain cytokine associated T cells, and a low antibody response at the highest level of vector administration.

Additional related work has been more recently developed by researchers from the Wistar Institute, including Dr. Ertl, in collaboration with the original applicant for this patent application, MBF Therapeutics. One set of these experiments, described in Kurupati et al., Cancer Immunol Immunother. 2018 October; 67(10):1533-1544, evaluated the ability of adenoviral vector comprising a DNA sequence encoding one of two canine cancer antigens (tyrosine-related protein 1 (Trp-1) or canine tyrosine-related protein 2(Trp-2)) in a gD fusion protein to generate T cell immune response in dogs. Kurupati et al. indicated that the selected adenoviral vector was used because of its own very high immunogenicity. A T cell response was observed for the Trp-1/gD adenoviral constructs in dogs (immune responses for the Trp-2/gD constructs were not measured). Otherwise, the work reported in Kurupati et al did not expand on the teachings of the '816 Wistar patent.

In still another set of even more recent experiments supported and/or performed by the same entities (MBF and Wistar), an adenoviral vector comprising an a gD fusion protein (gD FP) encoding sequence (ES) (gDFPES) construct similar to those described in the '816 patent, but encoding a fusion protein called K9Melapoly that comprised a combination of five predicted immunogenic amino acid sequences (comprising a set of predicted T cell epitopes from both Trp-1 and Trp-2 canine melanoma tumor-specific antigens along with human cancer-related immunogenic proteins tyrosinase, gp100, and MAGE-A1, in a fusion protein along with gD domains, where the antigenic sequences were separated by alanine-alanine ("A-A") spacers, apparently similar to the approach taken in Zhang and Ertl, supra). This work is described in a currently unpublished patent application. The work described in that patent application concludes that the GD-K9Melapoly fusion protein-encoding adenoviral vector was able to induce CD8+ T cell responses. In some respects, the vaccine also exhibited CD4+ effects, but in other cases such effects were described as "marginal" or "low," which the researchers attributed to the selection of epitopes that target MHC Class I molecules. Three dogs tested with the vaccine produced certain, robust CD8+ T cell responses, but almost a similar number of dogs (2) were considered low responders. CD4+ responses, as noted were low or, at best, comparable with respect to only CD95+CD4+ cells. The tested and in-detail described construct was not designed to induce humoral, innate/adaptive, or innate immune responses, and, accordingly, such responses were not measured in the study.

Despite the promising results reflected in the '816 patent and various related publications and patent documents, in the over eleven year period since the publication of corresponding International Patent Application WO/2008/027394 the development of gD fusion protein treatments for cancer or viral diseases has remained remarkably slow and limited, with no known human clinical trials of such products initiated yet, and few publications directed to research involving such constructs other than those cited in this disclosure.

There additionally remains several potential issues associated with the successful development of these and similar types of products for clinical application. In particular, despite significant advances in the understanding of T cell biology in recent decades, T cell vaccine products have often failed to result in clinically meaningful responses. For example, Gilbert, Immunology. 2012 January; 135(1): 19-26, reports "Although many ways of inducing T cells by vaccination have been assessed, the majority result in low level, non-protective responses" and only one on-market vaccine as of 2012 was thought to work primarily through T cell immunity. Even using multiple-antigen viral vector vaccine constructs developed by leading pharmaceutical company Merck have failed to deliver results in phase II clinical studies. Id. Results with adenovirus, pox virus, and a few other viral vectors have appeared more promising than with DNA vaccines to date. Id. However, as acknowledged by even the '816 patent, viral vector-based immunization approaches can be associated with immune responses, rendering such products unsuitable for therapeutic application. For example, as reported in Gilbert, 2012, supra, in cancer clinical trials involving viral vectors expressing p53 as the antigen, immune responses were directed against the viral vector rather than p53 in the majority of patients.

Despite the extensive amount of research reported on in the Wistar Art, relatively few other researchers have studied or reported on biotechnology applications of gD fusion proteins or related constructs. US Patent Publication No. 20030236396, which names a group of inventors apparently associated with University of Lausanne, University of Pennsylvania, and leading healthcare company Becton Dickinson, describes generation of truncated HSV gD polypeptides (e.g., comprising amino acids (AAs) 1-337 of HSV-1 gD), and noting the ability of such polypeptides to promote glycosylphosphatidylinositol (GPI) anchoring, secretion, and other properties. Most of the '396 application's disclosure focuses appears on the use of such gD sequences for the development of polypeptide expression products, which can be cleaved away from the gD sequence after expression. Although Examples 12 and 13 describe gD fusion protein constructs these appear to have been made to demonstrate the secretion-promoting abilities of such gD sequences, as Example 13 is focused on the cleavage of gD from the non-gD portion. Example 14 discloses prophetic use of constructs encoding such gD sequences in the context of restorative gene therapy, but no examples or disclosure are provided describing or suggesting the use of such constructs as vaccines or immunogenic agents. As such, the '396 application appears directed to a fundamentally different approach than the Wistar Art. It is also noteworthy that the '396 application also was abandoned prior to any substantive examination, no related patent applications were filed, and no related publications appear to exist in the literature, suggesting that these institutions did not view such ideas to be promising enough to be developed further or that the actual results associated with the specific constructs did not work as intended.

Other reports of gD fusion proteins in the literature have been primarily, if not exclusively, focused on understanding the basic biology of gD/HSV, rather than in the development of compounds for use as vaccines or immunotherapeutic agents (Zhou and Roizman. 2007. PNAS USA. 104:4142-4146. 10.1073/pnas.0611565104; Zhou et al. 2002. Proc. Natl. Acad. Sci. U.S.A. 99:15124-15129. 10.1073/pnas.232588699; & Menotti et al. 2008. J. Virol. 82:10153-10161. 10.1128/JVI.01133-08).

Complicating the predictability of gD related constructs further is fact that much of the research actually conducted with gD fusion proteins to date has been in mice and a growing body of scientific research has demonstrated that success with one treatment in one species is often not able to be successfully extended to other species, and this is particularly true in the case of translating mice data to larger animals such as dogs, horses, pigs, cows, primates, and humans. SFE Akhtar, Camb Q Healthc Ethics. 2015 October; 24(4): 407-419. Mak et al. report that successful translation from animal models to human data in cancer treatment, specifically, has been less than 8%, which the authors attribute in part to the prevalent use of mice models. Am J Transl Res. 2014; 6(2): 114-118. Hayden, 2014, Nature News (available at Nature.com/news/misleading-mouse-studies-waste-medical-resources-1.14938). The challenge of translating success in mice to other animals has already demonstrated to have occurred with gD fusion protein-expressing constructs in at least one case, as noted by Ertl et al. (2014), supra. As such, the efficacy of such constructs in other animals remains unclear, and this is especially true in the case of animals such as pigs and cows in which HVEM does not appear to be expressed by native cells.

From the foregoing it can be seen that while there have been many recent discoveries in connection with the development of novel vaccines, the predictability of success in therapeutically modulating immune systems with new nucleic acid vaccine constructs in larger animals or people, even when such new constructs are somewhat similar to those that have exhibited immunogenicity in vivo in several mice studies (as in the case of gD fusion protein-expressing constructs), still often remains relatively low and outcomes with existing approaches may be surprisingly more limited than desired. As such, the successful development of products that can improve on the performance of those constructs already known in the art, and new applications of such existing or new products in existing or new therapeutic or prophylactic applications, will often still require the application of inventive ingenuity.

Principles of Construction & Associated Abbreviations

These principles should be consulted in interpreting this disclosure.

Any heading(s) here (e.g., "Principles of Construction & Associated Abbreviations") are used for convenience and should not be construed to limit the scope of the invention. Except where clearly otherwise indicated, aspects of the invention described in part or entirely under a heading can apply to other aspects described in other sections of this disclosure.

Unless expressly otherwise indicated, description of terms known in the art is for exemplifying versions or embodiments only; and is not intended to limit the scope of any aspect of the invention. Unless defined otherwise, all technical and scientific terms used herein have the same meanings as commonly understood by one of ordinary skill in the art and implicitly comprise the broadest interpretation based on such usage as well as any narrower interpretation(s) based on specific descriptions provided here. In general, any methods and materials similar or equivalent to those described herein can be used in the practice or testing of embodiments of the invention, the methods, devices, and materials described herein.

The inclusion of "(s)" after an element indicates that ≥1 of such an element is present, performed, and the like. E.g., a composition comprising NAM(s) comprising NS(s) means a composition including one or more NAMs collectively (and possibly also individually) comprising one or more NSs.

For sake of conciseness symbols are used wherever appropriate. E.g., "&" is used for "and" and "~" is used for "about." The indicator "+" is sometime combined with a value to indicate "or more than" (e.g., "1+ NAM" means "one or more NAMs"). The symbols > and < are given their ordinary meaning (e.g., ≥1 means "greater than 1", <2 means "less than 2," e.g., ≥2 NAMs means "more than two NAMs"). Similarly, the indication "≤" means "less than or equal to" and "≥" means "equal to or more than." A slash "/" can indicate "or" (A/B means A or B) or can indicate an element with 2 names.

The abbreviation "WRT" means "with respect to." "ACB" in connection with steps/elements means "are characterized by" (e.g., methods ACB steps) and "CB" is used to abbreviate the phrase "characterized by." "AW" means "associated with." ACA means "are characterized/characterizable as" and ICA means "is characterized/characterizable as."

Ranges of values are used to concisely refer to each value falling within the range within an order of magnitude of the endpoints of the range without having to explicitly write each value. For example, a recited range of 1-2 should be interpreted as implicitly disclosing each of 1.0, 1.1, 1.2, 1.3, 1.4, 1.5, 1.6, 1.7, 1.8, 1.9, and 2.0 and a recited range of 10-20 is to be interpreted as implicitly providing support for each of 10, 11, 12, 13, . . . 19, and 20). All recited ranges include the end points of the provided range, regardless of how the range is described, unless the exclusion of such endpoints is clearly indicated, regardless of the terminology used to describe the range. For example, a range between 1 and 5 will include 1 and 5 in addition to 2, 3, and 4 (and all numbers between such numbers within an order of magnitude of such endpoints and within such endpoints, in this example 1.1 and 4.9).

Terms of approximation, such as "about" or "approximately" are sometimes used to conveniently refer to a range of closely related values or where a precise value is difficult to measure or a precise measurement is difficult to define. Unless otherwise stated, all exact values provided herein are representative of corresponding approximate values and vice versa (e.g., all exact exemplary values provided with respect to a particular factor or measurement can be considered to also provide a corresponding approximate measurement, modified by "about," where appropriate—e.g., disclosure of "about 10" is to be understood as also providing support for 10 exactly). Ranges described with one or more approximate numbers should be interpreted as indicating that all endpoints and other relevant values encompassed by the range may be similarly described, regardless of any different presentations included in this disclosure (e.g., "about 10-20" should be interpreted in the same manner as "about 10-about 20"). The scope of value modified by a term of approximation will depend on the context of the disclosure or understanding of those skilled in the art. In the absence of such guidance, terms such as "about" should be understood as meaning +/−10% of the indicated value(s).

Lists of elements are sometimes employed for conciseness. Unless indicated, each member of each list of aspects or features should be viewed as an independent aspect of the invention. Each such aspect can have and often will comprise nonobvious properties with respect to the other listed elements.

The terms "a" and "an" and "the" and similar referents are to be construed to cover both the singular and the plural, unless otherwise indicated herein or clearly contradicted by context. Terms in the singular implicitly convey the plural and vice versa herein, unless clearly contradicted by context or plausibility (e.g., a passage referring to use of a "composition" implicitly discloses corresponding use of corresponding "compositions," and vice versa).

Terms such as "here" & "herein" means "in this disclosure" unless otherwise indicated. The abbreviation "TD" similarly means "this disclosure." The term "i.a." (sometimes "ia" or "ia") means "inter alia" or "among other things." "Also known as" is abbreviated "aka." "ORT" means "otherwise referred to." The modifier "OTI" means "of the invention." "AOTI" means "aspect(s) of the invention." "ATAOTI" means "adaptable to" AOTI(s). "PMCs" means "principles, methods, or compositions." "ITA" means "in the art." "KITA" means "known in the art." "POOSITA" means "person of ordinary skill in the art." "DEH" means "discussed elsewhere herein." "DFEH" means "discussed further elsewhere herein." "CEH" means "cited elsewhere herein." "EH" means "elsewhere herein." "SFE" means "see, for example."

In the absence of other definition or understanding ITA, the term "some" WRT elements of a method or composition means "two or more" & WRT a part of a whole means "at least 5%" (i.e., ≥5%). The abbreviation OSMGAOA means "one, some, most, generally all (i.e., at least 75%), or all," each of which is an independent aspect of the described feature.

Fragments of abbreviations provided here are given the meaning of the presented parts of the abbreviation. E.g., "OSMOA" means "one, some, most or all" and "GAOA" means "generally all or all." Abbreviations provided in this disclosure are often combined, e.g., "WRT OSMOA" means with respect to one, some, or all and the abbreviations "EP" ("expression product") and "ES" ("encoding sequence") are parts of the combined abbreviation "EPES" meaning "expression product encoding sequence."

The modifier "DOS" means detectable or significant/detectably or significantly. "Significant" means results that are statistically significant using an appropriate test in the given context (e.g., p:0.05/0.01).

"AAW" means "associatively applied with." A composition or method is AAW another method/step or composition/element when the application results in DOS enhanced clinical effects (CEs), physiological effects, and the like.

AAW can comprise co-administration/application, sequential administration/application, or both, 1+ times.

Use of the term "or" herein is not meant to imply that alternatives are mutually exclusive unless clearly stated or clearly contradicted by context. Thus, in this disclosure, the use of "or" means "and/or" unless expressly stated or understood by one skilled in the art. The occasional explicit use of "and/or" herein has no effect on this interpretation of "or." The scope of "or" meaning "and/or" in a phrase such as "A, B, and/or C" implicitly supports each of the following embodiments: A, B, and C; A, B, or C; A or C; A or B; B or C; A and C; A and B; B and C; A (alone); B (alone); and C (alone). The term "also" means "also or alternatively" (abbreviated "AOA") unless expressly stated.

Terms such as "combination," "and combinations," or "or any combinations" WRT listed elements means combinations of any or all thereof. The abbreviation "CT" means any and all possible "combination(s) thereof."

Terms such as "including," "containing," and "having" should be interpreted openly herein, e.g., as meaning "including, but not limited to," "including, without limitation," or "comprising," unless the description clearly states otherwise. Comprising means including any detectable amount of an element or including any detectable performance of a step. Description of an aspect "comprising" or "including" a step or an element should be interpreted as AOA including that element/step (with any other steps/elements or alone).

Unless clearly contradicted, a description of any AOTI using terms such as "comprising" or "including" with reference to a step/element simultaneously implicitly discloses corresponding AOTIs that (1) consists of ("CO") of the step/element (or "only is"), (2) consist(s) essentially of the step/element, (3) substantially consists of ("SCO") the step/element (or "substantially is" or "substantially only" is/are the step/element), (4) generally consists of ("GCO") the step/element (or is "generally adapted" to, is "generally composed" of, "generally is," "generally only" is/are, "generally are," the element, and the like), (5) predominately comprises ("PC") ("mostly" or "primarily" comprises) the step/element, (6) materially comprises ("MC") the step/element, and (7) appreciably comprises ("AC") the step/element.

The phrases "consists of" (abbreviated "CO") & "consists essentially of" are well understood in patent disclosures given their ordinary meaning here.

"Substantially consists of" ("SCO") means ≥95% of the referenced class is made up of the referenced element and "substantially associated" means that at least 95% of a referenced item are associated with a second referenced item. "Substantially all" means at least 95% of the referenced items/steps meet(s) the indicated condition.

Phrases such as "generally consists of" (abbreviated "GCO"), "generally is," "generally are," "generally all," "generally," or "generally is composed of" means the referenced element makes up 75%+ of the related whole. Similarly, the phrase "generally associated" means ≥75% of an element is associated with a 2nd referenced item (e.g., ≥75% of 1 agent is associated with a 2nd agent). Phrases such as "generally most" and "generally all" mean ≥75% of the referenced items/steps meet the indicated condition.

"Predominately comprises" (abbreviated "PC") means that detectably greater than 50% of the composition is composed of the referenced element/component and "predominately associated" is construed similarly.

"Materially comprises" ("MC") means ≥5% of the composition/component is made up of the subject element/component. The phrase "materially associated" is similarly construed. The phrase "in material part" means ≥5% of the referenced items/steps meet the referenced condition.

The phrase "appreciably comprises" (abbreviated "AC") means at least 1% of the composition is composed of the referenced element/component. The phrase "appreciably associated" means that at least one percent of an element is associated with another referenced element.

Changes to tense or presentation of terms (e.g., using "comprises predominately" in place of "predominately comprises") should not be interpreted as modifying the meaning of the related phrase unless indicated.

Abbreviations for these terms are used here and combined for sake of conciseness. For example, the phrase "a composition MCPCGCOSCO or CO element X" is used to describe compositions that (1) materially comprise element X, (2) primarily comprise element X, (3) generally consist of element X, (4) substantially consist of element X, or (5) consist of element X. Similarly, a passage that refers to "compositions that PCGCO or SCO element Y" provides support for compositions that primarily comprise, generally consist of, or substantially consist of element Y.

Although some elements may be described in terms of a "means for" performing a function or a "step for" performing a method, no element of this disclosure should be interpreted as indicating a "means-plus-function" construction unless such intent is clearly indicated by use of the terms "means for" or "step for." Terms such as "configured to" or "adapted to" are not intended to suggest a "means-plus-function" interpretation, but, rather, indicate an element is configured to, designed to, selected to, or adapted to achieve a certain performance, characteristic, property, or the like using the principles described herein and/or that are generally known in the art.

Unless otherwise indicated, compositions specifying a percentage are by weight unless a different value would be understood ITA. If a variable is not accompanied by a value, any previously provided value typically applies.

All described methods can be performed in any suitable order unless otherwise indicated or contradicted by context/plausibility. Unless contradicted, elements of a composition can be assembled in any suitable manner by any suitable method. Unless contradicted, any combination of elements, steps, components, and/or features of aspects of the invention and all possible variations thereof, are within the scope of the invention.

Numerous examples of aspects are provided in this disclosure to illuminate such parts of the invention. The breadth and scope of the invention should not be limited by any of the exemplary embodiments. No language in the specification should be construed as indicating any element is essential to the practice of the invention unless such a requirement is explicitly stated.

All references, including publications, patent applications, and patents, cited herein, are hereby incorporated by reference to the same extent as if each reference were individually and specifically indicated to be incorporated by reference and were set forth in its entirety herein. The disclosure of such documents relating to compositions and methods can be combined with the teachings provided herein to provide additional useful compositions and applications. However, the citation and incorporation of patent documents herein is limited to the technical disclosure of such patent documents and does not reflect any view of the validity, patentability, and/or enforceability of any claims thereof. Moreover, in the event of any conflict between this disclosure and the teachings of such documents, the content of this disclosure will control with respect to properly understanding the various aspects of the invention. Numerous references have been included in this disclosure to incorporate information available from other sources that illustrate the scope of the invention or aid in putting aspects of it into practice. While efforts have been made to include the most relevant references for such purposes, readers will understand that not every aspect of every cited reference will be applicable to the practice of the invention.

I. Additional Terms and Abbreviations

The following description of terms and listing of abbreviations is provided to assist readers of this disclosure in understanding the invention. This disclosure is not intended to limit the scope of any terms ordinarily understood in the art. As such, any description of such terms should be considered to refer to certain aspects and to exemplify the meaning of the referenced term. Additional terms and abbreviations are provided in other parts of this disclosure (e.g., "related" and "similar" with respect to amino acid residue (AAR) sequences (AARSs)), are well known in the art (e.g., DNA), or both (e.g., CpG, MHCI, and MHCII).

A "biomolecule" here typically means a composition comprising, PC, GCO, or CO a PPT or nucleic acid. In aspects, a biomolecule can include other molecules made by cells/synthetic counterparts, e.g., lipids & carbohydrates.

The term "inducing" means DOS inducing, promoting, or enhancing an event/outcome, such as IR(s) (generally), particular IR(s) (e.g., ITIC IR(s)) or T cell IR(s)), or CE(s), e.g., reduction of symptom(s). "Enhancing" comprises increasing the magnitude, scope, duration, or other characteristic, typically of another event or composition. "Promoting" means increasing the likelihood of occurrence, frequency of occurrence, and the like.

Terms such as "block," "inhibit," or "reduce" herein with respect to IR(s), CE(s), checkpoint pathway(s) (CP(s)), or other physiological or cellular processes means reduces, attenuates, stops, makes less likely, or prevents as dependent on context—e.g., a biomolecule that "blocks" a checkpoint pathway reduces, inhibits, or stops such a checkpoint pathway from its typical operation in the given context. Both such effects (inducing and reducing) mean at a detectable level and implicitly comprise at a statistically significant ("significant") level. Antigenic PPTs (Ags) are typically not IMs/PIMs and are not Adjuvant(s). While Ags induce IR(s), IMs and adjuvant(s) induce IR(s) generally and are not associated with a disease causing agent (DCA). Thus, typically, GAOA Ags and PIMs are not-related, are heterologous, and are distinct in functions (e.g., combination expression product (CEP) Ags inducing Ag-specific IR(s) and PIM(s) inducing generalized IR(s)). In aspects, Ags can be PIMs and vice versa. As such, in some AOTIs Ag(s) are PIM(s) & in many AOTIs some, most, generally all, or all (SMGAOA) Ag(s) in CEPs are not PIM(s).

The modifier "peptidic" means composed of an expressible AARS. E.g., a peptidic CI (PCI) is a checkpoint inhibitor including AARS(s).

"CCEPM" means complementary clinical event promoting method. A CCEPM is a method that when AAW delivery of CCEPCs induces CEs. E.g., WRT treating cancer, CCEPs include surgery or radiation therapy.

"CCEPC" means complementary clinical event promoting composition. CCEPCs are compositions that induce CEs when AAW complete expression product (EP) encoding sequence (ES) compositions (CEPESCs), including vaccines, therapeutics, and medicaments that treat symptoms.

Phases such as "applied in association with," AAW, delivered in association," or "administered in association" mean delivery or administration of 2+ methods, steps, compositions, or combinations in any suitable manner(s), including, unless clearly contradicted, co-administration and sequential administration, repeated administration or application, and the like. "Delivery" or "administration" implicitly means delivery/administration of an "effective amount" ("EA") (an amount that effectively induces IR(s) in a TR, in a population of TR(s), e.g., determined through 1-3 clinical trial(s), or both (whether reference to EA(s) is made or not)). Terms like "deliver" refer to the transfer of a composition (e.g., a CEPESC) to a physiological site, tissue, cell, or to/into a TR. "Delivery" encompasses delivery to the intracellular portion of a cell or extracellular space(s). Delivery of a NAM into the intracellular portion of a cell is ORT as "transfection." Delivery and administration are often used synonymously here. Description of elements of compositions herein, unless contradicted, also are implicitly to be understood as being present in EA(s).

The modifier "EL" means "entire length" and is used to refer to WT biomolecules, such as WT PPTs. E.g., an EL HSV-1 gD means AAs 1-394 of HSV-1 gD. The "EL" modifier can also refer to a domain (e.g., a gD receptor binding domain, gDRBD).

An immunomodulator ("IM") is a composition that modulates IR(s) (e.g., that induces IR(s) or block/inhibit IR(s) in a non-Ag specific manner.

Unless otherwise indicated, PPTs described WRT a WT protein, class of proteins, etc., encompass both PPTs CO the AARS of the reference protein(s) and also FPs comprising the AARS and heterologous AARS(s). E.g., an "EAT-2 PPT" provides simultaneous support for PPTs that both (1) have an AARS consisting of a WT EAT-2 sequence (which may be an entire WT EAT-2 PPT or an FF) or a FV and (2) that comprise any such sequence and additional AARS(s).

Two sequences (nucleotide or AA (amino acid)), such as 2 sequences in a single recombinant molecule that have different origins, compositional characteristics, or both, can be described as being "heterologous" relative to each other and, conversely, sequences that share such origin(s) or compositional characteristics are "homologous." In WT PPTs and NAMs, origin is the sole determinant of homology herein. Origin in such respects refers both to genes and gene products. Homologs include PPTs recognized as homologous ITA based on functional, structural, and compositional characteristics (e.g., human EAT-2 and murine EAT-2; PRV gD and HSV-1 gD; canine influenza HA and human influenza HA; etc.). However, with respect to variants (FVs), compositional similarity to a WT biomolecule is the determinant of homology. For example, a FP comprising a FV of a human EAT-2 and a variant of a HSV-1 gD would be heterologous given that each AARS is related to PPTs from different species.

The term "exogenous" can be used to indicate a referenced molecule or the referenced activity that is introduced into a non-native context, such as the introduction of a nucleic acid molecule (e.g., a plasmid) into a non-native cell or host. An exogenous nucleic acid molecule can be introduced to a cell, for example, by introduction of an encoding nucleic acid into the host genetic material such as by integration into a host chromosome or as non-chromosomal genetic material such as a plasmid. The term "endogenous" is usually used to refer to a referenced molecule or activity that is present or typically present in a context, such as in a cell, a tissue, or a TR.

The term "construct" means a recombinant NS and typically is used synonymously with expression product encoding sequence (EPES).

The abbreviation RVRHRSII means "related, very related, highly related, substantially identical, or identical" with respect to two NSs or AARSs. RVRHRSI is construed similarly except for excluding identical sequences. Functional variant ("FV") sequences ACA related, very related, highly related, substantially identical (RVRHRSI) or, in the case of FV AARSs both RVRHRSI & SVSHSSCE to WTC(s). "SVSHSSCE" means similar, very similar, highly similar, or substantially compositionally equivalent." Identity/relatedness and similarity of sequence(s) is defined by optimally aligning sequence(s) using a tool such as BLAST, LALIGN, or CLUSTAL using appropriate settings. "Related" means at least 70% identical, very related (VR) means ≥80% identity; highly related (HR) means ≥90% identity or no more than 2 differences in composition in sequences with less than 10 components; substantially identical (SI) means ≥96% identical or no more than 1 difference in sequences with less than 1 component. Description of a "related" sequence also implicitly discloses corresponding AOTI CB VR, HR, or SI WRT the related sequence. Similar ("S") AA sequences exhibit ≥75% AARS similarity; very similar (VS) AARSs are 85% similar; highly similar (HS) AARSs are ≥92% similar; and substantially compositionally equivalent (SCE) AARSs are ≥98% similar. Such AOTI are DFEH. "MCRT" means "most closely related to," which is defined in terms of relatedness unless specified. References to FFs & FVs apply to any preceding sequences in a sentence. Thus, e.g., a "PPT, FF, or FV" means the EL PPT, FFs of the PPT, and FVs of the EL PPT or any of the FFs of the PPT.

FVs and FFs can exhibit suitable, comparable, or improved function(s) in the counterpart WTC sequence/biomolecule (PPT/NAM). "Comparable" functionality WRT to measurable functions means functionality that is not significantly different than the counterpart or that is within +/−20% of the WT function. "Suitable" functionality means exhibit (sometimes ORT as retaining) function(s) such that the function DOS exhibit(s) the result of the function (e.g., DOS induction of IR(s)). In aspects, "suitable" functionality means at least 50% of the function of the WT counterpart. "Improved" functionality (improvably functional) means DOS improvements in function(s).

Terms such as "treat" generally mean to DOS reduce, stop, inhibit, alleviate, or ameliorate, the underlying cause of physical symptoms of disease causing agent associated diseases (DCAADs), and encompass, as AOTI, "curing" a DCAAD (eliminating detectable indication(s) of the DCAAD in TR(s)). Terms like "prevent," "prophylaxis," "immunize," and "vaccinate" mean to induce IR(s) that are DOS protective in TR(s) when subsequently challenged with an associated DCA and encompass reduction in the likelihood of acquiring, duration, extent, or severity of a DCAAD, each as an AOTI complete prevention (lack of detectable disease). Other facets of AOTI CB treatment or prevention of DCAADs are DEH.

The descriptor "anti-" herein typically means blocking, reducing, reversing, or diminishing. E.g., an "anti-cancer composition" is a composition that has one or more of such effects on a cancer condition in TRs. In connection with Abs and ligands, "anti-" is used to describe an Ab/ligand that binds (and typically specifically binds) to a referenced target.

In AOTI, molecules, such as polypeptides and nucleic acid molecules of the invention ACA being "isolated" nucleic acids. For example, in methods described below, clinically relevant antigens are "isolated" from expression products or clinically relevant antigen-encoding nucleic acid molecules or nucleotide sequences are "isolated" from a disease-causing agent's genetic material/information (or portion thereof), such as from an ORF contained in a viral genome. Isolation in this respect is a concept that is understood in the art and the art is replete with methods for isolating biomolecules, such as nucleic acid sequences (e.g., by hybridization) and peptides (e.g., by affinity chromatography, ELISA, SDS-PAGE, and the like). The term "isolated" with respect to a nucleotide sequence usually refers to a polynucleotide that is not immediately contiguous with both of the coding sequences with which it is normally immediately contiguous (on the 5' end, on the 3' end, or both). Isolated polynucleotides include recombinant polynucleotides maintained in heterologous host cells or purified (partially or substantially) polynucleotides in solution. Isolated RNA molecules include in vivo or in vitro RNA transcripts of the polynucleotides of the present invention. Isolated polynucleotides or nucleic acids according to the present invention further include such molecules produced synthetically.

The following table lists abbreviations that are frequently used in this disclosure and provides a description of the meanings/scope thereof:

| Abbreviation | Term | Brief Description |
|---|---|---|
| AA/AAR | Amino acid/ AA residue | Any amino acid expressible from a NS in a TR |
| AAC | Associative applied composition | A composition that is AAW CEPESC(s) in methods OTI. AACs can be CCCs and vice versa. As such, examples of each are interchangeable unless contradicted. |
| AARS | Amino acid residue sequence | A sequence of amino acid residues; part or all of a PPT |
| Ab | Antibody | Any type of antibody. Typically, Ab fusion proteins (AbFPs) are described separately |
| AE | Adverse events | Events reportable as adverse events WRT applicable U.S. FDA regulation(s) |
| Ag | Antigen | An AARS/PPT that induces an antigenic IR with respect to DCA(s) |
| AgES | Antigen-encoding sequence | A NS encoding antigen(s) (Ag(s)) |
| AgV | Antigen variant | A variant of a WT antigen that is suitably, comparably, or improvably antigenic |

-continued

| Abbreviation | Term | Brief Description |
|---|---|---|
| aHV, αHV, or a-HV | Alpha-herpesvirus | Term either used to refer to biomolecules from viruses in this family or FFs/FVs that are related to such EL WT biomolecules |
| BC | B-cell | Antibody producing cells comprising a BCR. and classified as B cells |
| BCE | B-cell epitope | An epitope recognized by a BC |
| CaPNP | Calcium phosphate nanoparticle | Any type of Ca phosphate nanoparticle that promotes transfection of NAVs |
| CC | Combination composition | A composition comprising CEPES NAM(s) and one or more CCC(s) |
| CCC | Combination composition component | A component of a CC that enhances IR(s) associated with the CEPESC or induces IR(s) or CE(s) not induced by the CEPESC |
| CE | Clinical effect | A clinically relevant effect in TR(s) - e.g., reduction in frequency, delay of onset, reduction in severity, increase in cure, reduction of symptoms, or other favorable change(s) in clinical indicator(s) (at an individual or population level, generally or dependent on context) |
| CEP | Combined expression products | All PPT(s) expressed from EPES(s) of a CEPESC |
| CEPES | Combined EP ES(s) | The NS(s) encoding a CEP |
| CEPESC | Complete EP ES composition | A composition comprising all referenced EPES(s), associated NAM(s), and other components (e.g., CaPNP(s)) |
| CI | Checkpoint inhibitor | A molecule that acts as a checkpoint inhibitor in TR(s). A "PCI" is a PPT CI. |
| CM | Checkpoint modulator | A molecule that modulates a checkpoint pathway in TR(s). |
| COE | Cell(s) of expression | Cells in which CEPESC(s) are expressed |
| CP | Checkpoint pathway | A term given its ordinary meaning ITA |
| CPCR | Checkpoint pathway cell receptor | A cell receptor that forms part of a checkpoint pathway |
| CPRL | CP receptor ligand | A ligand for a receptor in a CP (note, often CPCRs are CPRLs and vice versa, e.g., WRT "self-ligand" CPRLs) |
| CPSTAP | CP signal transducing adaptor protein | An adaptor protein that modulates member(s) of a checkpoint pathway |
| CRA | Clinically relevant antigen | An AARS/PPT that exhibits DOS CE(s) in a relevant context proven through clinical testing in TR(s) or a population of TR(s) |
| CS | Coding sequence | A PPT-encoding NS, expressible in TR(s) |
| CSAE | cytokine syndrome AE(s) | Cytokine-associated AE(s) including cytokine storm effects, cytokine syndrome AEs, & Vaccine-Associated Enhanced Respiratory Disease ("VAERD") |
| CSM | Co-stimulatory molecule | A molecule that induces a stimulatory checkpoint, e.g., an ICRL of a co-stimulatory ICR (a concept known ITA) |
| CTL | Cytotoxic T lymphocyte/CD8 | A modifier associated with cytotoxic action(s) of CD8 T cells or an associated IR, such as a T cell cytotoxic IR |
| DC | Dendritic cell | Cells recognized as DCs by POOSITA |
| DCA | Disease-causing agent | A pathogen, cancer/cancer cell, or other disease-causing agent treatable through induction of an effective antigenic IR |
| DCAAD | DCA associated disease | A disease/condition AW a DCA, injurious or potentially injurious to TR(s) |
| DCR | DC receptor | A receptor expressed on dendritic cell(s) |
| DCUF | DC uptake facilitating | A modifier associated with AARSs that DOS facilitate DC uptake of associated AARS(s) in FPs. The modifier "UF" means "uptake facilitating" and can be applied to other cells, e.g., ICUF means "immune cell uptake facilitating" |
| DIV | De-immunization variation or variant | A variation that reduces the immunogenicity or antigenicity of a PPT/AARS in a TS or a FV of a PPT comprising such a variation |
| EEI | Expression enhancing intron | An intron that enhances the expression of associated CS(s) |

-continued

| Abbreviation | Term | Brief Description |
|---|---|---|
| EP | Expression product | A PPT expressed from an NS in a CEPESC |
| EPES | EP encoding sequence | A NS encoding EP(s). EP and ES are associated with other terms (e.g., PCIES means a PCI encoding sequence). |
| EPESNAM(s) | EPES NAM(s) | NAM(s) of a composition (EPESC) comprising EPES(s) |
| ES | Encoding sequence | A NS sequence that encodes a PPT or AARS. E.g., a gDPES is a NS that encodes a gDP |
| ETS | Extracellular targeting sequence | An AARS that targets a referenced target expressed externally to/on cell(s) (e.g., a receptor on cell(s)) |
| FF | Functional fragment | A fragment of a PPT or NS that exhibits a detectable function that is suitable comparable, equivalent, or superior to the corresponding function of the whole/parent PPT or NS; the term 'fragment" refers to the fact that the FF contains only a portion of the whole/parent PPT or NS. FFs typically are not made by fractionation. |
| FL | Flexible linker | A linker that is at least 33% composed of glycine residues |
| FP | Fusion protein | A protein comprising two or more heterologous AARSs, typically that each exhibit distinct DOS functions |
| FV | Functional variant | A variant that is at least related to a referenced sequence and exhibits suitable, comparable, or improved functionality in one or more respects to a WT counterpart |
| gD | Glycoprotein D | An abbreviation for an EL WT glycoprotein D protein (gDP) of an alphaherpesvirus or a modifier used to refer to gD-related PPTs/AARSs |
| gDAgFP | gD: Antigen fusion protein | A fusion protein comprising one or more functional alphaherpesvirus glycoprotein D sequences and one or more antigen sequences |
| gDD/gDS | Glycoprotein D domain/sequence | An AARS of a gDP, a functional fragment thereof, or a variant of either thereof |
| gDP | gD polypeptide | a PPT comprising gDS(s) |
| gDSS | gD signal sequence | An AARS that functions as a gDSS, typically a WT gDSS, a FF of such a AARS, or a FV of either |
| GSRAgV | Glycosylation site removal Ag variant | A variant Ag in which potential or actual glycosylation sites, are removed. Implicitly includes NLGSRAgVS (N-linked glycosylation site removal Ag variants). |
| GSRV | Glycosylation site removal variant (variation) | FV(s) of AARS/PPT(s) where ≥1 known or expected glycosylation sites are removed/ a modifier referring to such variations. Implicitly discloses NLGSRV(s). |
| IC | Immune cell | Any cell of the immune system, including innate immunity cells, adaptive immunity cells (e.g., T and B cells), and innate trained immunity cells (DCs and NKCs) |
| ICITM | Immune cell internal target modulator | An ITM that significantly, primarily, generally, or only exhibits effects in ICs |
| ICR | Immune cell receptor | A receptor that is abundantly expressed on ICs and when modulated induces IRs. |
| ICRL | Immune cell receptor ligand | A ligand for an ICR |
| ICSTAP | Immune cell STAP | A STAP that significantly, primarily, generally or only exhibits effects in ICs (e.g., a DAP-12 PPT) |
| IM | Immunomodulator | A compound that DOS modulates IR(s) |
| IR | Immune response | Any DOS immune response in TR(s) |
| IRV | Immunodominance reduction variation | A variation in an Ag that reduces immunodominance |
| ISNS | Immunostimulatory nucleotide sequence | A NS that is inherently immunostimulatory, such as an immunostimulatory CpG sequence |

-continued

| Abbreviation | Term | Brief Description |
|---|---|---|
| ITIC | Innate trained immune cell | A cell of the innate trained immune system, such as NKCs and DCs |
| ITICITM | ITIC internal target modulator | A PPT that modulates activity of an internal target in ITICs |
| ITICR and ITICRL | ITIC receptor and ITICR. ligand, respectively | Receptors and ligands of ITICs, respectively |
| ITICSTAPs | ITIC signal transducing adaptor proteins | STAPs that modulate ITIC ICRs, e.g., SAP and EAT-2 |
| ITIPIMs | Innate Trained Immunity Peptidic Immunomodulators | Peptidic immunomodulator(s) that predominantly, generally, substantially, or only induce significant IRs in ITICs |
| ITM/ITIM | internal target modulator or IT IM | A PPT that DOS modulates a target biomolecule present in a cell's interior |
| ITS | intracellular targeting sequence | An AARS that targets a referenced intracellular target (e.g., an organelle, a PPT in the nucleus or other organelle, or an internal portion of a receptor) |
| MgDS and MgD | Modified gDS and modified gD, respectively | A non-WT gDS that is not described in the Wistar Art such as a gDS that exhibits significantly reduced HVEM binding, significantly preferred binding for a non-HVEM receptor, or both; (2) comprises GSRV(s); (3) or a combination thereof. A MgD is a gDP comprising MgDS(s). |
| MHCIE | MHCI epitope | An epitope AW MHCI presentation |
| MHCIIE | MHCII epitope | An epitope AW MHCII Ag presentation |
| MSFL | Mid-sized flexible linker | A linker ≥4 AARs in length and ≥33% composed of Gly residues |
| MSL | Mid-sized linker | A linker of at least 4 AARs |
| NAM | Nucleic acid molecule | A type of a nucleic acid molecule in a CEPESC. Typically, each NAM is present in significant copies (e.g., ≥ 1 MM copies) |
| NASM | Non-antibiotic selection marker | A selection marker that is not an antibiotic resistance marker |
| NAV | Nucleic acid vector | A nucleic acid vector |
| NFP | Non-fusion protein | A PPT comprised of an AARS of or that is RVRHR or SI to a single WT PPT |
| NGD or NgD | "Non-gD" | A modifier used to describe an AARS or PPT that is heterologous to a gDS (not a gDS or a related variant of a gDS). E.g., a NgDICRL is a non-gD ICRL and a NgDCI is a non-gD checkpoint inhibitor |
| NGDICRTS | Non-gD ICR targeting sequence | An ICR TS heterologous to gDRBDs |
| NHA | Non-human animal | TR(s) other than human beings |
| NDISTR | Non-DCA immunosuppressed target recipient | TR(s) not in a state of checkpoint immunosuppression at the time of CEPESC administration |
| NKC | NK cell | A natural killer cell |
| NLGSRV and NLGSRAgV | N-linked GSRV and N-linked glycosylation site removal AgV | Variations/FVs in which N-linked glycosylation sites are removed through substitution or deletion of AAs. NLGS means "N-linked glycosylation site." |
| NonCMIMP(s) or NCMIMP(s) | Non-Checkpoint-Modulating Immunomodulator PPT(s) | PPT(s)/AARS(s) that are IM(s) and not a PCI, such as a Paj/cytokine |
| NS | Nucleotide sequence | Sequences of nucleotide bases, such as DNA or RNA sequences |
| OCEP | Other composition expression product | PPT(s) expressed from NS(s) in compositions other than CEPESCs |
| PAg/PCRA | Putative antigen/ Putative CRA | PPT/AARS predicted to be an Ag/CRA |
| PAj | Peptidic adjuvant | An adjuvant that is a peptide or AARs (e.g., a part of a FP), typically encoded by ESs |
| PE | Polyepitope | A polyepitope sequence or a modifier relating to such sequences (e.g., a NS sequence encoding a PE) |
| PFD | Profusion domain | A profusion domain of a gDP (WT/FV/FF) |
| PIM | Peptidic immunomodulatory | A PPT that is an immunomodulator |
| polyUb | Polyubiquitin | A term known ITA (ordinary meaning) |
| PPT | Polypeptide | A peptide, polypeptide, or protein, including a multimeric peptide or protein |

-continued

| Abbreviation | Term | Brief Description |
|---|---|---|
| SCM | Stimulatory CM | A molecule acts as a CM that stimulates immune system activity in a TR. |
| SCS | Self-cleavage site | A site acted on by a self-cleavage element (e.g., a 2A PPT cleavage site) |
| SCUP | Strong constitutive universal promoter | A promoter recognized as having all of these qualities in TRs, such as a CMV promoter or a CAG promoter. |
| STAPM | STAP modulator | A PPT that modulates a STAP or STAP pathway (e.g., a PPT that blocks a STAP : ICR. pathway). E.g., an IC STAPM is a PPT that modulates a STAP/STAP pathway in an IC |
| TC | T cell | (self-explanatory/known ITA) |
| TCE | T-cell epitope | An epitope recognized by a T-cell |
| TFA | Transfection-facilitating agent | An agent associated with a vector, such as a NAV, that promotes uptake of the vector into cells, such as CaPNPs |
| TH | T-helper/CD4 | A modifier to indicate T-helper/CD4 T cell or associated IR - a CD4/TH immune response (e.g., a MHCII response) |
| TH17TCE | Th17 T-cell epitope | A TCE that primarily, generally, or only induces Th17 cytokine responses in TR(s) |
| TH1TCE | Th1 T-cell epitope | A TCE that primarily, generally, or only induces Th1 cytokine responses in TR(s) |
| TH2TCE | Th2 T-cell epitope | A TCE that primarily, generally, or only induces Th2 cytokine responses in TR(s) |
| TMD | Transmembrane domain | An AARS that corresponds to or is a variant of a WT transmembrane domain of a PPT, such as a TMD of a WT gDP |
| TME | Tumor microenvironment | The environment of cancer cells in and around a tumor including nearby non-transformed cells and milieu |
| TR | Target recipient | Subject(s) intended to receive a referenced CEPESC (e.g., a pig, a dog, a horse, or a human). |
| TREGE | TReg epitope | An epitope that induces a TReg IR |
| TS | Targeting sequence | An AARS that binds a referenced PPT, e.g., an ICR. E.g., a DCRTS is a DCR TS. |
| WT | Wild-type | A modifier used to identify a naturally occurring form of a PPT, cell, NS, biomolecule, organism, or the like. |
| WTC | Wild-type counterpart | A biomolecule/sequence that is a referenced counterpart of a FF or FV. Homologs also can be described as "counterparts" of referenced biomolecules |

Common acronyms used in the specification, such as longer acronyms which combine shorter acronyms in the table above, are provided here to aid in understanding the invention:

| | |
|---|---|
| AbFP | Antibody (Ab) fusion protein |
| CDR | Complementarity determining region |
| CIMP | Checkpoint innnnunonnodulator polypeptide |
| DCR | Dendritic cell receptor |
| DCRTS | Dendritic cell receptor targeting sequence |
| EPESNAM | Expression product encoding sequence nucleic acid molecule |
| ERTPS | Endoplasmic reticulum targeting/processing sequence |
| ESE | Exonic splicing enhancer |
| ETS | Extracellular targeting sequence |
| gDAgFP | Glycoprotein D antigen fusion protein |
| gDAgFPES | Glycoprotein D antigen fusion protein encoding sequence |
| gDFPES | Glycoprotein D fusion protein encoding sequence |
| gDP | Glycoprotein D protein |
| gDPES | Glycoprotein D polypeptide encoding sequence |
| gDRBD | Glycoprotein D receptor binding domain |
| gDSFP | Glycoprotein D sequence fusion protein |
| gDVS | Glycoprotein D variant sequence |
| HRSIOI | Highly related, substantially identical, or identical |
| ICTIM | Immune cell target immunomodulator |
| ICTS | Immune cell targeting sequence |

-continued

| | |
|---|---|
| IRES | Internal ribosome entry site |
| ITICICRTS | Innate trained immune cell immune cell receptor targeting sequence |
| ITICICRTSFP | Innate trained immune cell immune cell receptor targeting sequence fusion protein |
| MGAOA | Most, generally all, or all |
| MGASAOA | Most, generally all, substantially all, or all |
| NANCIPI | Non-checkpoint innate peptide immunomodulator |
| NGDCI | Non-glycoprotein D checkpoint inhibitor |
| NGDICRTSFP | Non-glycoprotein D immune cell receptor targeting sequence fusion protein |
| NGDPCI | Non-glycoprotein D peptidic checkpoint inhibitor |
| NLGSRAgVS | N-linked glycosylation site removal Ag variants |
| NVNBO | Non-viral, non-bacterial pathogenic organism |
| NVNBM | Non-viral, non-bacterial pathogenic microorganism |
| PCI | Peptidic checkpoint inhibitor |
| PCM | Peptidic checkpoint modulator |
| PEFP | Polyepitope fusion protein |
| PCGCOOCO | Predominantly comprises, generally consists of, or consists of |
| PCGCOSCO | Predominantly comprises, generally consists of, substantially consists of |
| PCM | Peptidic checkpoint modulator |
| PCOGCOCO | Primarily consists of, generally consists of, or consists of |
| PCRAES | Putative clinically relevant antigen encoding sequence |
| PTPS | Proteosonne targeting/processing sequences |

-continued

| | |
|---|---|
| RVRHR | Related, very related, highly related |
| RVRHROSI | Related, very related, highly related, or substantially identical |
| RVRHRSI | Related, very related, highly related, substantially identical |
| RVRHRSIOI | Related, very related, highly related, substantially identical, or identical |
| S/MAR | Scaffold/matrix attachment region |
| SCS | Self-cleavage site |
| SMGAOA | Some, most, generally all, or all |
| SVSHR | Similar, very similar, highly related |
| SVSHSOCE | Similar, very similar, highly similar, or compositionally equivalent |
| SVRHSOCE | Similar, very related, highly similar, or compositionally equivalent |
| RBD | Receptor binding domain |
| TAA | Tumor associated antigen |
| UbL or UBL | Ubiquitin-like |
| VRHROSI | Very related, highly related, or substantially identical |

SUMMARY OF THE INVENTION

This invention provides new methods and compositions for inducing immune response(s) (IR(s)) in target recipient(s) (TR(s)) comprising the delivery of glycoprotein D polypeptides (gDP(s)) and antigen(s) (Ag(s)), typically through the delivery of complete expression product (EP) encoding sequence (ES) composition(s) (CEPESC(s)) comprising nucleic acid molecule(s) (NAM(s)) comprising nucleotide sequence(s) (NS(s)) comprising gD polypeptide encoding sequence(s) gDPES(s) and antigen (Ag) encoding sequence(s) (ES) (AgES(s)). Such methods are characterized by (CB), i.a., (1) combined expression product (s) (CEP(s)) expressed from such combined expression product encoding sequences compositions (CEPESCs) comprising (a) novel Ag(s), Ag combinations, or antigen variant(s) (AgV(s)) (e.g., glycosylation site removal Ag variant (GSRAgV(s))), (b) Ag-associated TS(s) (e.g., intracellular targeting sequence (ITS(s)), e.g., proteosome targeting/processing sequence(s) (PTPS(s)), e.g., polyUb(s)), (c) peptidic immunomodulator (PIM(s)) (e.g., innate trained immune cell (ITIC) internal target modulator (ITM) (ITICITM(s))/innate trained immune cell signal transducing adaptor protein(s) (ITICSTAP(s)), (e.g., EAT-2 polypeptide(s) (PPT(s))) or other peptidic checkpoint modulator(s) (PCM(s)), e.g., trap proteins targeted to checkpoint pathway targets), (d) modified gD sequence(s) (MgDS(s)); or (e) combinations thereof (CT); (2) nucleic acid molecule(s) (NAM(s)) comprising such combined expression product (EP) encoding sequences (ESs) (CEPESs) (a) comprising expression enhancing intron (EEI(s)); (b) being nucleic acid vectors (NAVs) (e.g., mRNA NAV(s), mixtures of NAV(s), NAV(s) comprising non-antibiotic selection marker(s) (NASM(s)), etc.); or (c) being associated with transfection facilitating agent(s) (TFA(s)), e.g., calcium phosphate nanoparticle(s) (CaPNP(s)) that enhance/induce immune response(s) (IR(s)); (3) such TR(s) (a) being non-HVEM-expressing TR(s), (b) being TR(s) not undergoing active disease causing agent (DCA) immunosuppression through DCA-associated checkpoint modulation, (c) being at risk or undergoing a cytokine syndrome condition, (d) being treated with or at risk of treatment with a "leaky vaccine," or (e) exhibiting a combination thereof. "Leaky vaccines" are known in the art as vaccines that do not provide sterilizing immunity and, accordingly, are associated with detectably or significantly (DOS) enhanced spread over pathogen through populations and to other populations as compared to an effective/sterilizing vaccine due such effects (see for example (SFE) Jin J et al. Biochem Biophys Res Commun. 2018; 496(3):846-851; Yu C et al. Vaccine. 2016; 34(50):6358-6366; and Trible B R et al. Virus Res. 2012; 164(1-2):68-77 with respect to leaky vaccine effects in porcine circovirus (PCV) and Allen G P et al. "Equid herpesvirus-1 (EHV-1) and -4 (EHV-4) infections." in Coetzer, J A W and Tustin, R C (Eds.), Infectious Diseases of Livestock. 2nd Edn. Oxford Press: Cape Town; 2004. pp. 829-859 concerning leaky vaccine effects in equine herpes virus (EHV)). Other such aspects of the invention (AOTI) are further described elsewhere herein (FDEH). Another facet OTI is embodied in CEPESCs comprising NS(s), NAV(s), and TFA(s) as described above. Other facets relate to related compositions (EP PPTs and related compositions, cells comprising expression product (EP) encoding sequence(s) (ES(s)) (EPES(s)), kits and packaged compositions, etc.), methods of production, related methods of use (e.g., use of CEPESCs comprising combination composition(s) CC(s) or associatively applied with (AAW) complementary clinical event promoting composition(s) (CCEPC(s)) or complementary clinical event promoting method(s) CCEPM(s)).

In aspects, gDP(s) are gD fusion proteins (gDFPs) comprising gD AARS(s) (gD sequence(s) (gDS(s)) sometimes glycoprotein D (gD) domain(s) (gDD(s)) and heterologous AARS(s). In aspects, heterologous AARS(s) comprise Ag(s) ("Ag" here can be used to refer to non-fusion protein (NFP) Ag(s) (e.g., endogenous Ag(s)) and to Ag(s) incorporated into fusion proteins (FPs)). Such gDFPs are referred to as glycoprotein D (gD) antigen (Ag) fusion proteins (FPs) (gDAgFPs). In aspects, gDAgFP(s) comprise ITS(s) associated with Ag(s) (e.g., exosome TS(s), endoplasmic reticulum TS(s), etc.). In aspects, ITS(s) are proteasome targeting/processing sequence(s) (PTPS(s)). In aspects, PTPS(s) comprise polyUb(s). In aspects, gDAgFP(s) comprise Ag(s) downstream of any gDS(s) in the gDAgFP. In gDP(s), such as gDAgFP(s), gDS(s) can comprise EL wild-type (WT) gDP(s), a functional fragment (an FF), or a functional variant (an FV) thereof. In aspects, defined gDS(s) of gDP(s) exhibit 1+ defined function(s), such as gD receptor (gDR) binding, checkpoint inhibition, inducing ER processing, ensuring desired placement of other gDDs, etc. In aspects, a gDS is combined with 1+ heterologous gDS(s) to generate a chimeric gDS that exhibits such gD function(s) (e.g., a chimeric gDRBD (gD receptor binding domain) that can bind gD receptor(s)). In aspects, FFs/FVs of gDS(s) or other referenced PPTs/AARSs/NSs exhibit suitable, comparable, or improved function(s) WRT to wild-type counterpart(s) (WTC(s)).

In aspects, a gDS FF or glycoprotein D (gD) variant sequence (gDVS) exhibits suitable, comparable, or improved function(s). In aspects, a gDS FF/gDVS exhibits OSMOA of the functions of its WT counterpart. In aspects, a gDS FF or gDVS exhibits <all functions of a corresponding WT AARS. Functions of gDS(s) include (1) glycoprotein D signal sequence (gDSS) functions; (2) receptor binding (e.g., nectin-1, nectin-2, or HVEM) (in gDRBD(s)) and target cell-binding (e.g., DCs, T cells, epithelial cells, or fibroblasts); (3) promoting uptake of the associated gDP (e.g., in a gDFP, such as a gD Ag fusion protein (gDAgFP)); (4) enhancing ER processing of the gDP; (5) enhancing GPI anchoring (6) membrane association (in a gD transmembrane domain (TMD)); or (7) any other measurable function associated with gDD(s) or combinations of any such functions. As DEH, gDP(s) can include non-functional WT gD AARSs or FVs thereof, but such AARS(s) do not characterize the gDP unless explicitly stated. gDP(s) also can comprise gDD(s) that are not discussed in detail herein but that exhibit function(s) (e.g., gDP(s) can be CB inclusion of gDS(s) that DOS contribute or cause oligomerization/dimerization of gDP(s)).

In aspects, CEPs are CB ia (1) comprising a combination of gDP(s) and (2) PPT(s)/AARS(s) that are (a) immune cell internal target modulator(s) (ICITM(s)) (e.g., immune cell signal transducing adaptor protein(s) (ICSTAP(s))); (b) checkpoint pathway (CP) signal transducing adaptor proteins (STAPs) (CPSTAP(s)); (c) CP signal transducing adaptor protein modulator(s) (STAPM(s)); (d) ITICITM(s) (e.g., ITICSTAP(s), e.g., EAT-2 PPT(s) or EAT-2 PPT(s)+SAP PPT(s)); or (e) innate trained immunity peptidic immunomodulators (ITIPIM(s)). In aspects, EP(s) are CB falling within 2+ of such categories of PPT(s) (e.g., an EAT-2 PPT typically is an ICITM, a CPSTAP, an ITICITM, and an ITIPIM).

In aspects, Ag(s) in CEP(s) are CB having certain feature(s), being associated with TS(s) (e.g., non-glycoprotein D (gD) (NGD) TS(s)), or both. In aspects, one, some, most, generally all, or all (OSMGAOA) Ag(s) in CEPs comprise FF(s) or FV(s) of EL WT Ag(s) but that DOS induce IR(s). In aspects, OSMGAOA Ag(s) in CEPs comprise AgV(s). In aspects, OSMGAOA AgV(s) in CEPs comprise (de-immunization variation or variant) (DIV(s)), e.g., glycosylation site removal variant(s) (GSRV(s)). In aspects, OSMGAOA AgV(s) comprise editope(s). In aspects, AgV(s) comprise removal of decoy epitope(s)/Ag(s), immunodominance reduction variation(s) (IRV(s)), or combinations. In aspects, Ag(s) in CEPs comprise both MHCI epitope(s) (MHCIE(s)) and MHCII epitope(s) (MHCIIE(s)), the combination resulting in DOS CD4 TC, CD8 TC, and B-cell (BC) IR(s) in TR(s). In aspects, OSMGAOA Ag(s) in CEPs are in PE(s). In aspects, OSMGAOA Ag(s) are associated by flexible linkers (FL(s)), mid-sized linker(s) (MSL(s)), or mid-sized flexible linker(s) (MSFL(s)). In aspects, OSMGAOA Ag(s) are associated with NGD TS(s). In aspects, such TS(s) are ITS(s). In aspects, such ITS(s) are PTPS(s), e.g., polyUb(s). In aspects, FP(s) in CEPs comprise self-cleavage site(s) (SCS(s)). In aspects, OSMGAOA Ag(s) are expressed in FPs, e.g., gDAgFP(s). In aspects, OSMGAOA Ag(s) in CEP(s) are expressed apart from gDP(s). In aspects, OSMGAOA Ag(s) are encoded by NAM(s) other than NAM(s) encoding a gDP or NAM(s) encoding ICITM(s), CPSTAP(s), ITICSTAP(s), or ITIPIM(s) In aspects Ag(s) comprise a mix of Th1/Th2/Th17 T cell epitope(s) (TCE(s)) & other features (e.g., DIV(s)) that DOS reduce cytokine syndrome adverse events (CSAE(s)) in TR(s). In aspects, Ag(s) comprise clinically relevant antigen(s) (CRA(s)) or putative CRA(s) (PCRA(s)).

In aspects, NAM(s) of CEPESC(s) comprise EEI(s) AW OSMGAOA EPES(s). In aspects, NAM(s) comprise strong constitutive universal promoter(s) (SCUP(s)) AW OSMGAOA EPES(s). In aspects, CEPESC(s) comprise 2+ NAM(s) comprising different NS(s). In aspects, NAM(s) are NAV(s). In aspects, NAV(s) are mRNA NAV(s) or DNA NAV(s). In aspects, DNA NAV(s) are plasmids. In aspects, NAV(s) are AW TFA(s). In aspects, TFA(s) are CaPNP(s) that DOS enhance IR(s) in TR(s).

In aspects, CEPESCs are employed in new conditions of use (conditions of use not described in the Wistar Art). In aspects, CEPESC(s) are used to treat/prevent disease-causing agent associated disease(s) (DCAAD(s)) in TR(s) treated with or at risk of treatment with a leaky vaccine. In aspects, CEPESC(s) are used to treat/prevent DCAAD(s) in non-DCA immunosuppressed target recipient(s) (NDISTR(s)). In aspects, CEPESC(s) are used to treat/prevent DCAAD(s) in TR(s) that are non-HVEM-expressing TR(s) (e.g., pigs). In aspects, CEPs comprise PCV Ag(s) and CEPESC(s) are used to treat/prevent other non-human animals (NHAs), humans, or CT. In aspects, CEPs comprise PRRSV Ag(s) and CEPESC(s) are used to treat/prevent PRRSV in pigs, other NHAs, or humans. In aspects, CEPs comprise ASFV Ag(s) and CEPESC(s) are used to treat/prevent ASFV in pigs, other NHAs, or humans. In aspects, Ag(s) comprise coronavirus (COV) Ag(s) and methods comprise treating/preventing COV in TR(s). In aspects, Ag(s) comprise influenza Ag(s) and methods comprise treating/preventing influenza in TR(s). In aspects, Ag(s) comprise an alpha-herpes virus (a-HV) Ag(s) and methods comprise treatment/prevention of a-HV diseases, such as EHV.

In aspects, Ag(s) comprise cancer Ag(s) (e.g., neoantigen(s), such as shared neoepitope(s), tumor associated antigen(s) TAA(s), oncogene PPT(s), and the like). In aspects, methods comprise treatment of bladder cancer, lymphoma, or other cancer in TR(s) including companion animals (e.g., dogs, cats, horses), humans, or both.

One aspect is CEPESC(s) including EPES(s) encoding an EP comprising gDAgFP(s) and ICITM(s), e.g., ITICITM(s), e.g., ITICSTAP(s). In aspects, EPs comprise ITICSTAP(s) that comprise EAT-2 PPT(s)/AARS(s) or a combination of EAT-2 and SAP PPT(s)/AARS(s). In aspects, an EAT-2 PPT/AARS is a EL WT EAT-2 PPT (e.g., human EAT-2), a FF of a WT EAT-2, or a FV (e.g., a DIV of an EAT-2 AARS/PPT).

In aspects, Ag(s) of the EP are associated with ITS(s), such as PTPS(s), such as polyUb(s), e.g., SEQ ID NO:1.

Another AOTI is CEPESCs comprising an EA of expression product encoding sequence nucleic acid molecule(s) (EPESNAM(s)) including EPES(s) encoding EP(s) comprising gDAgFP(s) & AgV(s). In aspects, OSMOA of the AgV(s) are contained in gDAgFP(s). In aspects, OSMOA of the AgV(s) are expressed as separate PPTs from the gDAgFP(s). In aspects, OSMOA AgV(s) of the EP are GSRAgV(s) and in aspects OSMOA of the GSRAgV(s) are NLGSRAgV(s). In aspects, other parts of the EP also comprise GSRV(s) (e.g., in the gDS or other possibly included aspects of the EP, such as, e.g., an ITII).

In aspects, NAM(s) comprise both EEI(s) & NASM(s). In aspects, CEPESCs comprise NAM(s) including (a) glycoprotein D (gD) antigen (Ag) fusion protein (FP) encoding sequence (ES) (gDAgFPES(s)) & (b) EEI(s) that DOS enhance gDAgFP expression (and in aspects DOS enhance gDAgFP-associated IR(s)). In aspects, the EPESNAM(s) also comprise SCUP(s), NASM(s), or CT. In aspects, expression product encoding sequence (EPES) NAM(s) (EPESNAM(s)) are NAV(s), e.g., mRNA NAV(s) or plasmid DNA NAV(s).

An additional aspect is CEPESCs including EPES(s) encoding EP(s) comprising gDAgFP(s) comprising MgDS(s). In aspects, MgDS(s) exhibit DOS reduced affinity for HVEM (WRT to HSV gDs); comprise DIV(s), GSRV(s), or both; exhibit enhanced affinity for a non-HVEM receptor; lack a functional gD TMD; lack a profusion domain (PFD); or comprise CT. In aspects, a gDAgFP comprises Ag(s) positioned downstream of any gDS in the gDAgFP. In aspects, gDAgFP(s) comprise Ag(s) positioned between gDSs in gDAgFP(s). In aspects, a MgDS is a chimeric gDS, is MCRT to a WT gDP of a virus endogenous to NHAs, e.g., pigs, dogs, horses, or cows. In aspects, such CEPs include immune cell (IC) target immunomodulator(s) (ICTIM(s)), CPSTAP(s), ITIPIM(s), or ITICITM(s) (e.g., ITICSTAP(s), e.g., EAT-2 PPT(s)).

An AOTI is CEPESC(s) comprising EA(s) of NAV(s) comprising nucleotide sequence(s) (NS(S)) including gD antigen (Ag) fusion protein (FP) encoding sequence(s) (ES(s)) gDAgFPES(s) & (b) being associated with TFA(s), such as CaPNP(s), that DOS IR(s) in TR(s). In aspects, CEP(s) thereof comprise Ag-associated TS(s), e.g., ITS(s); MHCIE(s) and MHCIIE(s); AgV(s) such as GSRAgV(s); MgDS(s); or CT. In aspects, NAM(s) comprise EEI(s), NASM(s), or CT.

Another AOTI is CEPESC(s) comprising 2+ NAM(s), e.g., a first NAM comprising gDAgFPES and a second NAM comprising (a) an immunostimulatory nucleotide sequence (ISNS); (b) ES(s) encoding a 2nd type of gDAgFP, (c) ES(s) encoding ICITM(s), ICSTAP(s), CPSTAP(s), ITIPIM(s), ITICITM(s), or ITICSTAP(s) (e.g., EAT-2 PPT(s)); (c) ES(s) encoding non-gD checkpoint inhibitor(s) (NGDCI(s)), non-gD immune cell receptor (ICR) targeting sequence (NGDICRTS) fusion protein(s) (FP(s)) (NGDI-CRTSFP(s)), nucleic acid non-checkpoint innate peptide immunomodulators (NANCIPI(s)) (e.g., cytokine(s)), antigen fusion protein(s) (AgFP(s)) (e.g., a FP comprising AgV(s), a polyepitope (PE) fusion protein (FP) (PEFP), or AgFP that is both), Ag(s), or other peptidic immunomodulator(s) (PIM(s)); or CT. In aspects, one or both NAMs comprise EEI(s), are NAV(s) (e.g., TFA-associated NAV(s)), or both. In aspects, EP PPTs comprise Ag-associated ITS(s) (e.g., PTPS(s)), DIV(s), GSRV(s), or combinations. In aspects, such CEP(s) comprise non-checkpoint immunomodulator polypeptide(s) CIMP(s), e.g., cytokine(s) (e.g., Th1 cytokine(s), e.g., IFNg or IL-2) or peptidic adjuvant(s) (PAj(s)) (e.g., heat shock protein(s)).

Another aspect is a CEPESC comprising an EA of NAM(s) encoding a gDFPAg or other gDP and ≥1 NGDCI. In aspects, the NGDCI is a PD-1/PD-L1 checkpoint inhibitor (CI) or a CD112R CI. In aspects, NGDCI(s) comprise a multimeric extracellular targeting sequence (ETS) PPT that lacks antibody sequences (e.g., a PD-L1 or CDR112R trap protein). In aspects, gDS(s) of the CEPESC also act as CIs in TR(s). In aspects, the CEP also comprises AgV(s), Ag-associated ITS(s), MgDS(s) (e.g., non-HVEM binding gDP(s)), ICITM(s), CPSTAP(s), ITIPIM(s), ITICITM(s), ITICSTAP(s) (e.g., EAT-2 PPT(s)) or combinations. In aspects OSMOA of the NAM(s) are NAV(s), e.g., TFA-associated NAV(s), e.g., CaPNP-associated plasmid(s).

In aspects, a CEPESC comprises an EA of NAM(s) comprising gDPES(s) and NGDICRTSFPES(s) (i.e., non-gD immune cell receptor (ICR) target sequence (TS) fusion protein (FP) encoding sequence(s) (ES(s))). In aspects, the NGDICRTSFP(s) comprise ITIC ICR TS(s). In aspects, the innate trained immune cell (ITIC) immune cell receptor (ICR) targeting sequence(s) (TS(s)) (ITICICRTS(s)) comprise DEC-205-TS(s). In aspects, the innate trained immune cell (ITIC) immune cell receptor (ICR) targeting sequence (TS) fusion protein (FP) (ITICICRTSFP) is a multimeric PPT and the ITICICRTS(s) lack antibody (Ab) sequences (e.g., the ITICICRTSs are DC receptor (DCR) targeting sequences (TSs) (DCRTSs), e.g., DEC-205-binding keratin AARSs or variants). In aspects, the CEP comprises an ICITM, ICSTAP, CPSTAP, ITIPIM, ITICITM, or ITIC-STAP, such as an EAT-2 PPT or AARS. In aspects, such a CEPESC is delivered to a TR that has pre-activated DCs (or the CEPESC comprises or is AAW activated DC(s)). In aspects, the NGDICRTSFP comprises Ag(s), such as AgV(s), and optionally ITS(s), such as PTPS(s), such as polyUB(s). A related aspect is a method of inducing IR(s) in a TR comprising delivering an EA of a CEPESC encoding a gDAgFP having any features described herein, and optionally (i) comprising ICITM(s), ICSTAP(s), CPSTAP(s), ITIP-IM(s), ITICITM(s), or ITICSTAP(s) (e.g., EAT-2 PPT(s)) or (ii) being delivered AAW with delivering an EA of a NAM encoding ICITM(s), ICSTAP(s), CPSTAP(s), ITIPIM(s), ITICITM(s), or ITICSTAP(s) (e.g., EAT-2 PPT(s)), and in further AAW with delivering an EA of a composition comprising NAM(s) including NGDICRTSFPES(s).

An AOTI is CEPESCs that are CCs including ≥1 of any above-described or otherwise provided CEPESC features & comprising EA(s) of combination composition components (CCC(s)) that DOS enhances IR(s) associated with CEPESC(s) or inducing IR(s) not induced by the CEPESC. In aspects, CCC(s) are vaccines. In aspects, CCC(s) are therapeutics. In aspects, CCC(s) are anti-pathogen or anti-cancer Abs. In aspects, CCC(s) are IC(s) (e.g., Ag- or IM-pulsed DCs, CAR-T cell(s), etc.).

AOTI include delivery of EA(s) of any of the above-described or otherwise provided CEPESCs of the invention to induce IR(s) in TR(s). In aspects, method(s) are performed to induce prophylactic IR(s) in TR(s). In AOTI, method(s) induce a therapeutic CE(s) in TR(s). In AOTI, method(s) are repeated ≥2 times (using the same or different CEPESC(s)). In AOTI, method(s) are AAW delivering EA(s) of CCC(s) or AAW CCEPM(s) or CCEPC(s).

Another AOTI is methods of inducing IR(s) in non-HVEM-expressing TR(s) comprising delivering an EA of CEPESC(s) to the non-HVEM TR one or more times. In aspects, the CEP comprises or predominantly comprises (PC), generally comprises (GC), consists of (CO), substantially consists of (SCO) (PCGCOSCO) or CO gDS(s) that exhibit DOS reduced HVEM binding in HVEM-expressing TRs. In aspects, the NS(s) encode a NASM. In aspects, the NAM(s) are TFA-associated NAV(s), such as CaPNP-associated DNA plasmids. In aspects, the CEP comprises non gD (NGD) peptidic checkpoint inhibitor(s) (PCI(s)) (NGDPCI(s)). In aspects, the CEP comprises AgV(s), such as GSRAgV(s). In aspects, the TR is a pig and the CEP comprises Ags against PCV, PRRSV, or ASFV. In aspects, OSMOA of the Ags of the CEP are associated with ITS(s), such as polyUb(s). In aspects, the EPESNAMs comprise EEI(s).

A further AOTI provides a method of inducing IR(s) against a leaky vaccine DCA, in TR(s) infected with a leaky vaccine DCA, or in TR(s) treated with a leaky vaccine effect vaccine comprising delivering to the TR(s) an EA of a CEPESC. In aspects, the leaky vaccine DCAAD is an influenza, EHV, or PCV.

Another AOTI is induction of IR(s) in TR(s) in NDISTR(s) comprising delivering EA(s) of a CEPESC to such TR(s) (e.g., a cancer patient). In AOTI, the Ag(s) of a CEP PCGCOSCO or CO pathogen DCA-associated Ag(s). In AOTI, such Ags comprise MHCIE(s) & MHCIIE(s), yet induce DOS BC, CD4 TC, & CD8 T cell (TC) IR(s). In aspects, method(s) result in DOS numbers of Ag-specific ICs in TR(s) not present before delivery of CEPESC(s) (e.g., TCs, natural killer cells (NKCs), or DCs)

A further AOTI is a method of inducing IR(s) comprising delivering EA(s) of CEPESC(s) ≥2 of the CEPESC(s) encoding different CEPs. In AOTI, a 1st CEPESC comprises a 1st gDAgFPES & a 2nd CEPESC comprises an encoding sequence (ES) encoding (a) different gDAgFP(s); (b) NGDAgFP(s), e.g., an NGDICRTSAgFP; (c) Ag(s) (e.g., AgV(s), PE(s), or combinations); (d) ICITM(s), ICSTAP(s), CPSTAP(s), ITIPIM(s), ITICITM(s), or ITICSTAP(s) (e.g., EAT-2 PPT(s)); or (e) CT.

These and other AOTI are further described and exemplified in the following sections of this disclosure. Any of the features described in this Summary of the Invention can be combined and any such other features.

DETAILED DESCRIPTION OF THE INVENTION

The invention described here provides new methods for inducing IR(s) in TR(s) comprising delivering EA(s) of CEPESC(s) comprising gDPES(s) and AgES(s), in 1, 2, or ≥2 NAMs & such CEPESCs. Some AOTIs are CB OSMOA gDP(s) in the CEP of such constructs being gDAgFP(s). CEPESCs (compositions/constructs OTI) typically also comprise additional features, e.g., innate trained immunity peptidic immunomodulator(s) (ITIPIM(s)) or an internal target immunomodulator (ITI), e.g., immunomodulatory signal transducing activator protein (STAP) (e.g., an ITIC-STAP, such as an EAT-2 PPT or an EAT-2 PPT and SAP PPT). Ag(s) of CEP(s) can be associated with ITS(s), such as PTPS(s), e.g., polyUb(s). Ag(s) also can be associated with DIV(s), such as GSRV(s). CEPESCs also can comprise MgDP(s). CEPESCs also can include NGDPCIM(s) (e.g., PD-L1 or CD112R trap proteins). CEPESCs can comprise non-viral vector NAVs with unique properties (e.g., growth in a triclosan selection system). CEPESC(s) often comprise 2+ NAVs comprising different NSs and often different ESs. NAVs of CEPESCs are often associated with TFAs, such as CaPNPs. EPES NAMs typically comprise EEI(s). The combination of some, most, generally all, or all (SMGAOA) of such elements provides CEPESCs advantageous properties lacking in compositions of the prior art, including gDFPES constructs of the Wistar Art. Methods of the invention provide new uses for such compositions that further enhance the applicability of such compositions in new ways, such as in the treatment of diseases in non-HVEM TR(s), in non-immunosuppressed TR(s), etc. These AOTI and more AOTIs are DEH.

Typically, CEPESCs are designed for use in ≥1 alphaherpesvirus infectable vertebrate target recipients (TRs). TR(s) can be any suitable type of such subjects. In aspects, TR(s) are associated with unique features, such as not expressing HVEM, having been previously treated with a "leaky vaccine," not having a checkpoint inhibition immunosuppressed state, or CT.

To better illustrate various AOTI, a detailed discussion of the various components of CEPESCs, EPs/CEPs, and related methods of use, etc., follows, focusing on each component in turn. However, as illustrated in, i.a., the Summary of the Invention and Exemplary Aspects, such various elements are often or typically combined with other elements to arrive at the numerous types of various compositions and methods provided by the invention.

I. Compositions

A. NAMs, NSs, AARSs, & PPTs

CEPESCs comprise NAM(s) and methods OTI typically comprise the administration of NAM(s) to TR(s). NAM(s) of CEPESCs comprise 1+ nucleotide sequences (NSs) including EPES(s) and possibly other NS(s), e.g., EEIs.

Terms such as "nucleic acid molecule," "nucleotide sequence," "nucleic acid construct," "nucleotide" or "polynucleotide" are closely related (and often can be used interchangeably), & KITA. Typically, terms such as "nucleic acid molecule" or "NAM" refer to a particular type (i.e., a particular copy) of a NAM in a composition or method. POOSITA will recognize that the phrase "nucleic acid molecule" references a single type/copy of NAM, rather than a single molecule, as CEPESCs will, in actuality, typically comprise more than 100,000,000 and often more than 1,000,000,000 individual copies of any single type of NAM. Typically, NAM(s) & other agents in compositions/methods OTI are present in EA(s), and any disclosure of NAM(s) or related compositions (e.g., NAVs or other vectors) will be understood to disclose that the described compound(s) are present in effective amount(s). Such AOTI are DEH.

NAM(s) can comprise, PC, consist essentially of, substantially consist of (SCO), or GCO 1+, often >1, >two, >three, >four, or more than five (e.g., 3-15, 4-12, 4-10, or 5-10) discrete NSs (sometimes referred to as functional nucleotide sequences (FNSs)) CEPESCs typically comprise NAMs comprising at least one gDPES.

In aspects, CEPESC(s) comprise only 1 NAM (e.g., a single type of plasmid or 1 type of mRNA). In other aspects, CEPESCs comprise ≥2 NAMs (e.g., 3, 4, 5 or more nucleic acid molecules, such as 2-20, 2-12, 2-10, 2-7, 2-6, 2-5, 2-4, or 2-3 NAMs). NAMs can be any suitable type of NAM, suitability WRT NAMs being typically determined by expressibility at a suitable/intended level and having other features suitable for clinical application as described here & DEH. In aspects, NAM(s) comprise, GCO, or CO RNA(s). In aspects, NAMs comprise, GCO, or CO DNA(s). In aspects, NAM(s) are single stranded. In aspects, NAM(s) are double stranded. Each NAM typically will be stable under typical expected conditions of use/storage (e.g., ≥6, ≥9, ≥12, ≥18, ≥24 months at RT (about 15-25/20° c., ambient (e.g., −50° C. to 50° C., −40° C. to 40° C., −35° C. to 35° C.), or accelerated stability temperature testing condition and humidity (per US FDA guidelines). Certain AOTI described further herein provide for CEPESCs having particular levels of stability of nucleic acid molecules. NAMs also will typically be non-toxic. In AOTI, NAM(s) are relatively non-immunogenic, not resulting in significant IR(s) in 1+TR(s) (e.g., as determined by clinical trial). However, in other aspects NAM(s) are inherently immunogenic in CEPESCs (as is the case with some RNAs and ISNSs). NAM(s) and CEPESCs are typically sterile. NAMs exhibit transient expression of ESs contained therein and do not DOS integrate into TR genome(s) (i.e., delivering NAMs does not constitute restorative gene therapy).

The term "construct" refers to NAMs comprising 2+ distinct NSs, which typically are heterologous and exhibit different/discrete and measurable function(s) (e.g., a nucleotide sequence (NS) comprising Cytomegalovirus (CMV) EEI, two or more Ag encoding sequences obtained from a canine cancer cell, and intervening sequences encoding either a SCS from another virus (e.g., a T2A SCS from asigna virus 2A), an artificial linker sequence, or both). The terms construct and CEPESC are used interchangeably here when referring to EPES constructs.

Unless otherwise indicated references to virus species generally, such as CMV, provide support for species of such viruses that infect humans and viruses recognized in the art under the same classification that infect NHA(s). E.g., references to influenza Ag(s) herein, such as hemagglutinin (HA), implicitly disclose both human influenza HA & NHA influenza HAs, such as canine influenza HAs, porcine influenza HAs, and the like. Thus, the term CMV implicitly provides support for AOTI relating to HCMV as well as other CMVs.

Constructs can be formed by any type of chemical synthesis or recombinant nucleic acid synthesis technology, numerous examples of which are KITA. Compositions & methods OTI comprise constructs comprising NSs encoding ≥1 (e.g., 2+ or 3+, such as 1-5, 1-4, 1-3, 2-5, 2-4, or 2-3) alphaherpesvirus glycoprotein D ("gD") sequences (gDS(s)) in combination with other NS(s), such as ≥1 EEI(s), AgES(s), or CT.

One type of construct that is typically combined with other NS(s)/construct(s) to form still larger constructs (e.g., vectors, DEH) is an "expression cassette." Many AOTI relate to NAM(s) comprising at ≥1 expression cassette (e.g., ≥1 expression cassette comprising ≥1 gDPES). In aspects, CEPESCs & methods OTI comprise NAMs comprising ≥2 expression cassettes (e.g., 2-4 or 2-3 expression cassettes). An "expression cassette" is KITA to mean a construct comprising (a) ≥1 coding sequence (CS) (ORT as a "gene") & (b) ≥1 regulatory sequence (DEH). Typical expression cassettes comprise a promoter operably linked to ES(s) (gene(s)). Other regulatory sequence(s)/control element(s) also can be present, e.g., a bacterial origin of replication, ≥1 selectable marker-encoding sequences, a signal which allows the plasmid construct to exist as single-stranded DNA (e.g., a M13 origin of replication), a multiple cloning site, a "mammalian" origin of replication (e.g., a SV40 or adenovirus origin of replication), or CT.

A "coding sequence" (CS) means a NS that is expressible in at least target host cells under suitable conditions. Expression products (both AARSs & nucleic acids) are also KITA as "cistrons." A CS can be a WT CS or can be an EPES having a synthetic CS but encoding a WT PPT, due to redundancy/degeneracy of the genetic code, splicing, or CT. The term "open reading frame" (ORF) is also used ITA to refer to CSs, but the term ORF typically is limited to a single expression sequence whereas a "gene" can comprise two, three, or more ORFs. The term "subsequence" is used sometimes to refer to a NS encoding part of an ORF, such as part of a fusion protein. However, subsequences are typically just described as "sequences" herein. POOSITA will be able to determine based on context whether a sequence is a subsequence or an entire coding sequence/ORF.

Numerous types of "regulatory sequences" are DEH, but commonly an expression cassette will at least comprise a promoter sequence, such as a SCUP. Expression cassettes often include a 3' untranslated region (UTR), which usually contains a polyadenylation (polyA) site, as DFEH.

NSs can have any suitable length. Most CSs will be at least 6 nucleotides (nt) (bases) in length (e.g., in a 2 AAR linker), AgES will typically be at least 12 nucleotides (NT/nt), and ≥21 bases in length for TCE ESs. In contrast, a gDSES/gDPES can be, e.g., ~100-2100, 200-1800, 300-1500 bases, 450-1250, or ~600-1200 nt in length (per coding strand). In AOTI, CEPESCs comprise NAMs that comprise at least about 2 kilobase pairs, ≥2.5 kbp, or ≥2.75 kbp, e.g., ~2.5-4 kbp/kb, ~2.5-5 kbp, or ~3-5 kbp). A kilobase pair (kb, or kbp) is 1,000 base pairs & a megabase pair (Mb or Mbp) is one million base pairs. The abbreviation "bp" means "base pair(s)" & "nt" means "nucleotides."

A NAM can be in any suitable form, such as a linear form (e.g., a mRNA or a linear expression element (LEE)) or a circular form (e.g., a plasmid) form, as well as double-stranded or single-stranded forms. E.g., RNA or DNA NAMs, which can include, e.g., cDNA, genomic DNA, synthetic DNA, and CT, may be double stranded or single stranded, and if single stranded typically will be a coding strand, but in AOTI can comprise a non-coding (anti-sense strand).

NSs can have any suitable origin or combination of origins, as in the case of "constructs." E.g., NSs can comprise prokaryotic sequences, eukaryotic mRNA, cDNA from eukaryotic mRNA, genomic DNA sequences from eukaryotic (e.g., mammalian) DNA, synthetic DNA sequences, and CT. E.g., NSs can comprise ≥1 sequences from e.g., a virus genome (e.g., a non-infectious viral genome), messenger RNA (mRNA), complementary DNA (cDNA), plasmid DNA (pDNA), or derivatives of pDNA (e.g., minicircles as described in (Darquet, A-M et al., Gene Therapy 4:1341-1349 (1997)). NSs can include a gene or gene fragment (for example, an EST or SAGE tag), exons, and introns. NSs can be recombinant polynucleotides, synthetic polynucleotides, or CT. E.g., a NS in AOTI can be a recombinant, synthetic, and/or mutant NS. POOSITA will understand terms such as "nucleic acid molecule" or "nucleotide sequence" to include any of the features associated with NAMs DEH. Production and use of nucleic acids is KITA (see, MOLECULAR CLONING, (2001), Sambrook and Russell, Eds. & METHODS IN ENZYMOLOGY: METHODS FOR MOLECULAR CLONING IN EUKARYOTIC CELLS (2003) Purchio & G. C. Fareed, Eds.

NSs can have any suitable composition. Suitability WRT NSs will typically be determined by, ia, the ability of the NS to carry out its intended function/exhibit its intended characteristics, and without possessing characteristics that detract from clinical use (e.g., undesired toxicity, immunogenicity, etc.). Typically, a NS is composed of polymers of deoxyribonucleotides (e.g., DNA) or ribonucleotides (e.g., RNA). Molecules of DNA and RNA in AOTI may be single, double, triple, or quadruple stranded form (SFE U.S. Ser. No. 10/407,695 and US20030100113). In aspects, NAMs are DNA molecules. In aspects, DNA molecules are circular, double stranded DNA molecules and typically are capable of stable extrachromosomal expression in host cells (plasmids). Plasmids and other vectors are DEH. DNA molecules comprising sequences encoding immunogenic proteins or that are otherwise immunogenic are often referred to here & ITA as "DNA vaccines." However, the use of the term "DNA vaccine" is not meant to necessarily limit the application of such a composition to prophylactic applications.

In aspects, NSs/NAMs are composed of RNA, such as a messenger RNA (mRNA). RNA may be, in one embodiment, in the form of a tRNA (transfer RNA), snRNA (small nuclear RNA), rRNA (ribosomal RNA), mRNA (messenger RNA), or micro RNA (miRNA). "RNA vaccines" in aspects DOS induce both humoral & cellular immunity. In aspects, RNA vaccine constructs DOS outperform corresponding DNA-based vaccines in terms of inducing IRs. RNA can be produced in vitro, i.e. outside the cells, using a DNA template containing a coding sequence, such as an AgES, or can be generated synthetically. In AOTI, an RNA vaccine NAM of a CEPESC is a non-replicating mRNA. In aspects, CEPESCs comprise RNA vaccine NAM(s) that are self-replicating mRNA that comprises/requires a $2^{nd}$ RNA to ensure copying of the RNA vaccine NAM in vivo (e.g., an alphavirus-derived system, such as an alpha virus, picornavirus, or flavivirus system). In aspects, an RNA vaccine NAM is encompassed within a cell or other composition for delivery to a subject, such as a mRNA vaccine-loaded DC. In aspects, RNA NAMs comprise a capping modification, a polyA sequence (e.g., a polyA of about 100-200 nt, such as about about 120-150 nt), a 5'-UTR (e.g., human heat shock protein 70 5'-UTR), one or more pseudouridine nucleosides, a phosphorothioate backbone, or a combination of any or all thereof, which detectably increases expression, half-life, or both. RNA vaccine technology is KITA and relevant PMCs that can be ATAOTI are provided in e.g., Pardi N et al. Nat Rev Drug Discov. 2018; 17(4): 261-279; Chahal J S et al, Proc Natl Acad Sci USA. 2016; 113(29): E4133-4; Vogel et al., (2017); Ulmer J B, Mason P W, Geall A, et al. (2012) Vaccine 4414-4418; Schlake T et al (2012) RNA Biol 9: 11, 1319-1330; McNamara et al (2015). J Immunol Res Article ID 794528; Ulmer J B, et al (2016) Curr Opin Immunol 41: 18-22; Ljungberg K et al. (2015). Expert Rev Vaccines 14: 177-194; Maruggi G, et al. *Mol Ther.* 2019; 27(4):757-772; Brito L A, et al. (2015) Adv Genet 89: 179-233; Sahin U et al (2014). Nat Rev Drug Discov 13: 759-780; Pardi N et al. Nat Rev Drug Discov. 2018; 17(4):261-279; Van Lint S et al. Expert Rev Vaccines. 2015; 14(2):235-251; Versteeg L, et al. Vaccines (Basel). 2019; 7(4):122; Jackson N A C, et al. NPJ Vaccines. 2020; 5:11; Feldman R A, et al. Vaccine. 2019; 37(25):3326-3334; and US 20140335112; US20190351040; US20200085852; WO2019126334; EP1797886B1; & US20200016274. The application of RNA vaccine technology to the constructs of this invention is a novel AOTI. RNA sequences may be or may be derived from, or may be variants or derivatives of, messenger RNA (mRNA), transfer RNA, ribosomal RNA, ribozymes, or CT. We conceive RNA constructs having features OTI will be useful in CEPESCs, despite the fact that not a single experiment in the Wistar Art is directed to such RNA constructs.

In aspects, CEPESCs comprising RNA sequence(s) encoding gDP(s) and Ag(s), such as gDAgFP(s) are provided. In aspects, RNA(s) are self-replicating RNA molecule(s). In aspects, RNA sequences comprise(s) a cap/capping modification (e.g., a 7-methyl-guanosine residue joined to the 5'-end via a 5'-5' triphosphate; SFE Banerjee A K, Microbiol Rev. 1980 June; 44(2):175-205), a stability/expression promoting polyA sequence (e.g., a polyA of about 100-200 nt, e.g., ~120-150 nt), or CT. In AOTI, the RNA molecule further comprises one or more of (a) a 5'-UTR (e.g., human heat shock protein 70 5'-UTR), (b) one or more pseudouridine nucleosides, (c) an at least partial phosphorothioate backbone, or (d) a combination of any or all thereof, which detectably increases expression, half-life, or both of the RNA molecule. In AOTI, the RNA molecules are loaded into and delivered in a dendritic cell. In AOTI, the RNA vaccine is delivered with a NAM encoding an ITII, such as an EAT-2 polypeptide-encoding DNA NAM. In AOTI, the RNA molecule FNSs of the composition also or alternatively comprise at least one PTPS-encoding sequence. In another aspect, the RNA molecule FNSs also or alternatively encode at least one epitope, at least one deglycosylation antigen variant, or both. In AOTI, the RNA molecule FNSs also or alternatively encode at least one linker between at least two antigenic sequences, a cleavage site (e.g., a 2A sequence or an intein), or a combination thereof. In AOTI, the RNA vaccine comprises sequences encoding at least one MHC I antigen against a disease-causing agent and at least one MHC II antigen against the same or a related disease-causing agent. In another aspect, the RNA vaccine also or alternatively encodes a B cell antigen. In AOTI, the RNA vaccine lacks any sequences encoding a B cell vaccine. In a particular case, the RNA vaccine comprises FNSs encoding an MHC I antigen and an MHC II antigen, either or both optionally comprising flanking sequences, without any B cell antigen to the disease-causing agent, wherein the expression of the RNA NAM results in a detectable, typically enhanced, often significant, and in several cases both significant and clinically relevant cytotoxic T lymphocyte/CD8 (CTL) response, a T-helper/CD4 (TH) response, and a B cell response. In AOTI, the RNA vaccine comprises one or more cancer antigens. In AOTI, the RNA vaccine comprises one or more pathogen antigens (e.g., viral antigens). The invention also provides methods of treating or preventing diseases comprising delivering to an alphaherpesvirus infectable vertebrate host an effective amount of any such composition or two or more of such compositions (e.g., in a prime/boost administration regime). In certain aspects, methods are performed in TR(s) that do not regularly express HVEM, e.g., swine. In such cases, the antigens may be PCV antigens, PRRSV antigens, or ASFV antigens, examples of which are provided elsewhere herein. In some aspects of the invention, compositions and method comprising both RNA and DNA vaccines of the invention are provided (e.g., a method in which a DNA vaccine construct is delivered followed by an RNA vaccine construct, or vice versa, or a combination of such constructs are delivered). In general, any of the various aspects and facets of the invention described herein can, where suitable, be performed with RNA vaccine constructs, as exemplified by the general use of "nucleic acid molecule" in most aspects and facets of the invention provided in this disclosure.

In aspects, NAMs in CEPESCs PC, GCO, or CO of DNAs. DNA NAMs may be, e.g., in form of plasmid DNA, viral DNA, linear DNA (e.g., an LEE), or chromosomal DNA or derivatives thereof, variants thereof, or CT.

"Nucleotides" (NTs/nts sometimes aka bases) are the monomeric units of NAMs. As KITA, NTs comprise bases and backbones. NAMs can be artificial nucleic acids that contain other types of backbones from WT NSs, but still retain ordinary bases. NSs also can comprise ≥1 artificial or modified nucleotides. However, in aspects most, generally all, or all (MGAOA) NSs comprise only conventional sugars, bases, & linkages, as found in RNA & DNA. In aspects, NSs include both conventional bases and substitutions (e.g., conventional bases linked via a methoxy backbone or ≥1 base analogs). In aspects, NAMs/NSs include nucleic acids containing analogues of natural nucleotides that have similar binding and other functional properties, and that typically are metabolized in a manner similar to naturally occurring nucleotides, as a referenced WTC NAM/NS or NAM/NS in WT form. Sugar moieties of a NSs may be ribose or deoxyribose, or similar compounds having known substitutions, e.g., 2' methoxy substitutions (containing a 2'-O-methylribofuranosyl moiety; SFE WO 98/02582) O 2' halide substitutions. Nitrogenous bases may be conventional bases (A, G, C, T, U), known analogs thereof (e.g., inosine or others; see The Biochemistry of the Nucleic Acids 5-36, Adams et al., ed., 11$^{th}$ ed., 1992), or known derivatives of purine or pyrimidine bases (see, Cook, PCT Int'l Pub. No. WO 93/13121) or "abasic" residues in which the backbone includes no nitrogenous base for one or more residues. Modifications to NSs in terms of incorporation of artificial or modified nucleotides are particularly tolerable in the 3rd position of a codon. Examples of modified nucleotides that can be incorporated in NSs are listed in, e.g., the MANUAL OF PATENT EXAMINING PROCEDURE § 2422 (9th Revision—2018). Additional and alternative sequence modifications are described elsewhere herein. In AOTI, NSs include bases that is/are oxetane modified. It also may be possible for CSs or other NSs to comprise one or more xenonucleic acids (XNAs). SFE Pinheiro, V. B. et al. Synthetic Genetic Polymers Capable of Heredity and Evolution. Science 336, 341-344 (2012).

NSs can include conventional phosphodiester bond or a non-conventional bond (e.g., an amide bond, such as found in peptide nucleic acids (PNAs)). In aspects, NSs comprise 1+ nucleotides that contain backbone portions not found in native DNA or RNA, but comprise ordinary bases. In aspects, an artificial NS is/comprises a PNA (e.g., WO 95/32305), a methylphosphonate backbone, or another alternative backbone. In aspects, NSs comprise backbones modified by replacement of ≥1 phosphodiester bonds with phosphorothioate bond(s). SFE Neilsen P E, Curr Opin Struct Biol 9:353-57 & Raz N K et al, Biochem Biophys Res Commun. 297:1075-84. In aspects, phosphorothioates DOS improve cellular uptake, bioavailability, or both (PMCs are described in Eckstein F. Nucleic Acid Ther. 2014; 24(6): 374-387). In aspects, NSs comprise chirally controlled oligonucleotides (SFE US 20200080083 & US 20020137921). In aspects, NS(s) comprise a modification that promotes DOS prolonged stability in one or more environments, e.g., NSs with chiral phosphorus linkages such as phosphorothioate or boranophosphate intermonomer linkages (SFE U.S. Ser. No. 10/457,945). Phosphorothioate nucleotide analogs and related compositions and methods ATAOTI are described in, e.g., U.S. Pat. No. 9,278,990 and WO 2018141908A1. In aspects, NSs comprise branched nucleotide sequence(s). E.g., nucleic acid polymerases can replicate a 2',5'-branched DNA (bDNA) molecule. SFE Döring J, Hurek T. Dual coding potential of a 2',5'-branched ribonucleotide in DNA. RNA. 2019; 25(1):105-120.

In aspects, NAMs/NSs include features that promote pre-expression processing, e.g., NAMs that that comprise introns, such as self-splicing introns (SFE U.S. Pat. No. 6,010,884). NSs can comprise sequences that result in other splice modifications at the RNA level to produce an mRNA transcript encoding EPs and/or at a DNA level by way of trans-splicing mechanisms prior to transcription (PMCs are described in, e.g., Chabot, Trends Genet (1996) 12(11):472-78; Cooper (1997) Am J Hum Genet 61(2):259-66; & Hertel et al. (1997) Curr Qpin Cell Biol 9(3):350-57).

NSs typically are presented here in single strand form (regardless of whether the sequence is part of a single stranded or double stranded NAM), in the 5' to 3' direction, from left to right, using the 1-letter nucleotide symbols commonly used ITA & in accordance with the recommendations of the IUPAC IUB Biochemical Nomenclature Commission.

In aspects of the disclosure, biomolecules, such as NAMs/NSs are labeled with labels such as "1st," "2nd," or "3rd," etc. Unless indicated, the use of terms such as "1st NS" and "$2^{nd}$ NS" is only for clarity and is not meant to indicate a specific order/arrangement of such sequences.

In contexts, NSs described herein are described as "functional" nucleotide sequences (FNSs). A FNS is any NS that exhibits DOS intended functions/properties in intended host cell(s)/target recipient(s) (TR(s)) under intended conditions of use, storage, replication, etc. A common function associated with a nucleotide sequence is the ability to be expressed. Another function is the ability to enhance the expression of another sequence, which is associated with sequences such as promoter sequences, enhancer sequences, & EEIs. Still other NSs are able to directly induce IR(s), e.g., ISNS(s).

1. Regulatory Elements

As noted above, expression cassette constructs typically include 1+, 2+, or more regulatory elements. "Regulatory elements" include any non-coding sequence(s) that aid in expression of CS(s), the stability of NS(s)/NAM(s), or both. Regulatory elements (aka, regulatory sequences) can be characterized as any NS that promotes, enhances, or controls expression/transcription of another NS (typically one or more CSs).

Typical regular elements include, for example, a promoter, an enhancer, an initiation codon, a stop codon, and a polyadenylation (polyA) signal. Regulatory elements are typically operably linked to CS(s). Regulatory elements include enhancer-promoter combinations, or other NSs that affect the expression or transcription of an associated, typically downstream NS (e.g., an expression-enhancing intron). Regulatory elements can be of various origins, both natural and synthetic, as exemplified throughout this disclosure.

Regulatory elements can be obtained from any suitable source. Transcriptional and translational control sequences for mammalian host cell expression vectors can be, e.g., excised from viral genomes. Polynucleotide sequences derived from the SV40 viral genome, e.g., an SV40 origin, early and late promoter, enhancer, splice, and polyadenylation sites can be as regulatory elements for a structural gene sequence in a mammalian host cell. Viral early and late promoters are often useful because both are easily obtained from a viral genome as a fragment, which can also contain a viral origin of replication (Fiers et al., Nature 273:113, 1978; Kaufman, Meth. in Enzymology, 1990).

Suitable promoters in NAMs can be inducible promoters, repressible promoters, and constitutive promoters. Examples of suitable promoters include cytomegalovirus hCMV immediate early gene promoter (CMV IE) (SFE U.S. Pat. No. 5,168,062), early or late promoters of SV40 adenovirus, Human elongation factor-1 alpha (EF-1 alpha) promoter, phosphoglycerate kinase promoters (e.g., the human PGK1 promoter), human metallothionein 1G promoter, UBC promoters, human beta actin promoters, U6 promoters, H1 promoters, & 7SK promoters. Other promoters include human immunodeficiency virus (HIV) long terminal repeat (LTR) promoter, MoMuLV promoter, avian leukemia virus promoter, Epstein-Barr virus immediate early promoter, Rous sarcoma virus promoter, and human gene promoters such as, but not limited to, the actin promoter, the myosin promoter, the hemoglobin promoter, and the creatine kinase promoter. Additional suitable promoters are described below and EH.

Promoter(s) can be multi-cell-operable promoter(s) (aka ubiquitous promoters), able to effectuate promoter functions in a number of different cells/TRs, typically without significant loss in functioning. Examples of ubiquitous promoters include the CMV IE promoter, the EF-1a promoter, PGK promoters, UCB promoters, Ubiquitous Chromatin Opening Element (UCOE) promoters and GUSB (hGBp) promoter (SFE Husain et al. Gene Ther. 2009; 16(7):927-932). In aspects, promoter(s) in construct(s) of comprise, PC, GCO, or consist of such ubiquitous/multi-cellular promoters. In aspects, promoters PC, GCO, or CO promoter(s) that can be characterized as ubiquitous promoters.

In aspects, promoters of NSs PC, GCO, or CO one or more tissue/cell specific promoters, exhibit promoter activity only in certain cell types/tissues or exhibiting significantly enhanced expression in certain cells/tissues. Examples of such promoters include muscles-specific promoters such as muscle creatine kinase (MCK) and desmin (1.7 kbs) and the α-myosin heavy chain (α-MHC; 1.2 kbs) promoter. In hematopoietic stem cells the synthetic MND promoter (Li et al., 2010) and the promoter contained in the 2AUCOE (ubiquitous chromatin opening element) have shown to drive a higher transgene expression compared to the EF1α and CMV promoters, respectively (Zhang et al., 2007; Koldej 2013; Dighe et al., 2014). High tissue specificity of gene expression was shown in both pancreatic tissue using the insulin promoter157. The α1-antitrypsin (hAAT; 347 bps) and the thyroxine binding globulin (TBG; ~400 bps) promoters drive gene expression restricted to the liver with minimal expression in other tissues (Yan et al., 2012; Cunningham et al., 2008). The ANF (atrial natriuretic factor) promoter drives expression in cardiomyocytes, the CC10 (club cell 10) promoter drives expression in human epithelial cells, the SP-C (surfactant protein C) promoter drives expression in lung epithelial cells, the C5-12 promoter is a synthetic muscle-specific promoter, and numerous neuronal specific promoters are known, such as the PDGF-β (platelet-derived growth factor-β) promoter. Other examples include mammalian troponin 1 promoters and skeletal alpha-action promoters. In AOTI constructs of are free of any tissue-specific promoters.

In aspects, promoters are associated with enhancer elements (e.g., a CMV enhancer), or other promoter elements (to form a hybrid promoter), to DOS enhance expression. Relevant PMCs are described in, e.g., Ara Hacobian et al. Tissue Engineering Part B: Reviews. June 2018.226-239.

Promoters of constructs can be constitutive promoters, inducible promoters, or repressible promoters, or CT. In AOTI, promoters in constructs comprise, PC, GCO, or CO promoters categorized as constitutive promoters (one or more unregulated promoter elements that allows for continual transcription of associated coding sequences). A constitutive promoter generally will cause an associated CS to be produced in a cell under most or all physiological conditions of the cell. Well-known constitutive promoters include the CMV IE promoter, the EF1α promoter, PGK promoters, SV40 promoters, UBC (Ubc) promoters, the human beta actin promoter, U6 promoters, the H1 promoter, chicken β-actin (CBA) promoter and its hybrid promoter derivative CAG are also constitutive promoters, as are the β glucuronidase (GUSB) and ubiquitin C (UBC) promoters.

Alternatively, promoter(s) comprise, PC, GCO, or CO inducible promoter(s), which are up- and or down-regulated in response to an appropriate signal/factor (aka an inducer). Inducible promoters ATAOTI include tetracycline response element (TRE) promoters or similar promoter (e.g., Tet-Off or Tet-on systems (Clontech, Palo Alto, Calif.)), a macrolide-inducible expression system (Weber W et al. Methods Mol Biol. 2004; 267:451-466.); a Coumermycin/Novobiocin-Regulated Gene Expression System (Zhao et al. Hum Gene Ther. 2003; 14(17):1619-1629); a light responsive promoter (SFE Hörner et al. Methods Mol Biol. 2017; 1651:173-186) a metallothionein promoter; an estrogen receptor promoter, a heat shock protein promoter, E1B promoter, a hypoxia induced promoter, lymphokine-inducible promoters (e.g., promoters inducible by interferons or interleukins), an ecdysone or ecdysone-analog-inducible promoters (ecdysone-analog-inducible promoters are commercially available through Stratagene (LaJolla Calif.)), or a MMTV LTR inducible promoter. Additional inducible promoters include arabinose-inducible promoters, a steroid-inducible promoters (e.g., a glucocorticoid-inducible promoters), isopropyl beta-D-thiogalactopyranoside (IPTG)/Lac inducible promoters (SFE Edamatsu H et al. Gene. 1997; 187(2):289-294), doxycycline inducible promoters (SFE Yang T et al. Plasmid. 2014; 72:29-35), and pH, stress, & heat-inducible promoters (SFE Voellmy R, et al. Cell Stress Chaperones. 2018; 23(4):455-466). Constructs comprising such promoter(s) are an AOTI as are uses of such constructs.

Promoter elements can originate from any suitable source. E.g., constructs can include one or more viral promoters, one or more natural non-viral promoters, one or more modified promoters, one or more synthetic promoters (e.g., hybrid promoters), or a combination of two or more thereof.

Viral promoters include, e.g., the CMV IE and SV40 promoters, as well as the adenovirus major late promoter (Ad MLP), and the herpes simplex virus promoter, among others. In AOTI, the promoters used in constructs of the invention include, primarily comprise, generally consist of, or consist of one or more viral promoters. For example, one aspect of the invention is a composition comprising one or more NAMs comprising FNSs encoding a gD antigen fusion protein (such as any of those described in the Summary of the Invention) operatively linked to a CMV IE promoter, and optionally comprising one or more other elements described in the Summary of the Invention, such as an expression-enhancing intron sequence, one or more PTPSs, or one or more ITIIs, such as an EAT-2 polypeptide.

Non-viral promoters, such as a promoter derived from the murine metallothionein gene, also can be used in constructs. In aspects, promoter(s) comprise, PC, generally consist of, or consist of one or more non-viral promoters. Non-viral promoters include the EF1α promoter and the human beta actin promoter, among others, as well as hybrid promoters (e.g., a CAG promoter) and purely synthetic promoters.

In AOTI, promoter(s) of construct(s) include, PC, GCO, or CO ≥1 hybrid (or "chimeric") promoters, such as a CMV-chicken β-actin promoter (CBA promoter) or a known derivative thereof, such as a CAG or CBh promoter (SFE Boye et al. Investigative Ophthalmology & Visual Science May 2006, Vol. 47, 852.). In aspects, a hybrid promoter exhibits tissue specific properties. E.g., combining a uroplakin II gene promoter with the enhancer sequence of the prostate stem cell antigen gene can express the antioncogenic E1A-androgen receptor specifically in bladder tumor cells (Wang D et al. Urol Oncol. 2010; 28(2):164-169. doi:10.1016/j.urolonc.2008.02.002). Other synthetic promoters are discussed in, e.g., Rushton P J. Methods Mol Biol. 2016; 1482:1-13. In one aspect, the invention provides constructs comprising a CAG promoter (SFE Miyazaki, J et al (1989). Gene. 79 (2): 269-77, & Alexopoulou A N, et al. BMC Cell Biology 9: 2, 2008, PMID 18190688). E.g., in aspects, constructs comprising a CAG promoter operatively linked to gD:antigen fusion proteins DEH and optionally further comprising any of the facets, aspects, or features of any such compositions, such as comprising EEI(s), one or more Ag-associated PTPS-encoding sequences, or an ICSTAP-encoding sequence, e.g., an EAT-2 PPT ES, are provided as an AOTI.

In aspects, promoter(s) in constructs are "strong" promoters. Strong promoters are promoters that are able to achieve a high level of expression according to one or more various ratings or tests known in the art. On such basis, for example, the CMV IE promoter (particularly when matched with the CMV IE enhancer), the EF-1a promoter, CAG promoter (when matched with the CMV IE enhancer), the SV40 early promoter, and TRE promoters are characterized as strong promoters, whereas the UBC (human ubiquitin C promoter) and GUSB, for example, are not considered to be strong promoters. Examples of methods & standards for the evaluation of strong and weak promoters are provided in, e.g., Powell S K et al. Discov Med. 2015; 19(102):49-57 and Qin J Y, et al. PLoS One. 2010; 5(5):e10611. In some aspects, ≥1 of the promoters incorporated into constructs will have a rate of inactivation that is the same or less than the CMV promoter in different cell types. Promoters that have a lower rate of deactivation than CMV include the human elongation factor-1 alpha promoter (EF1α promoter or EF-1a promoter) and CAG promoter, whereas PGK promoters have a rate of inactivation that is similar to or greater than CMV promoters. In one aspect, the promoter element(s) of constructs of the inventive compositions and methods also or alternatively to any of the other aspects described in connection with promoter elements herein comprise, primarily comprise, generally consist of, or consist of one or more strong promoters, such as CMV IE or CAG promoters. In one aspect, the constructs comprise, primarily comprise, are generally associated with, or only contain promoters that are both strong promoters and promoters with low deactivation rates such as a CAG promoter or an EF1α promoter. Thus, for example, the invention provides compositions comprising one or more NAMs that contain a gD:antigen fusion protein-coding sequence that is operatively linked to a strong promoter, a low deactivation rate promoter, or a promoter having such features, such as a CAG promoter, wherein the FNSs of the one or more NAMs can further include any of the various features described in the Summary of the Invention, such as an ITII-encoding sequence, an expression-enhancing intron sequence, a PTPS-encoding sequence, or a combination of any or all thereof.

In aspects, construct(s) comprise promoter(s) that is/are classifiable as a constitutive promoter, a ubiquitous promoter, or a constitutive and ubiquitous promoter. In one aspect, the promoter is further classifiable as a strong promoter. In still another aspect, the promoter is also or alternatively characterized as being a universal promoter. In aspects, OSMGAOA promoter(s) of constructs are SCUPs (being strong, constitutive, and universal).

In aspects, regulatory element(s), such as promoter(s), in constructs, result in DOS increase in expression of operably linked CS(s). In aspect(s), the regulatory element(s) result in "high level expression," which means levels of expression at least 5-fold, 10-fold, at least 20-fold, at least 50-fold greater, at least 100-fold greater, at least 1000-fold (3-log) greater, or at least 10,000-fold (4-log) greater or more, within the first 1, 2, or 3 days following transformation than without the regulatory element(s), than typical levels of endogenous gene expression, or both. In another aspect, transformation with a construct of the invention results in "persistent" high level expression. The terms "transformation" and "transfection" are used the same herein, unless expressly otherwise indicated or clearly contradicted by context and should be considered interchangeable with "transduction," wherever delivery of constructs through viral vectors is considered appropriate. "Persistent," high levels of expression means that high level expression of the coding sequence(s) (transgene(s)) persists for ≥1 week, typically ~2 weeks or more, for example, ≥3 weeks, ≥5 weeks, ≥7 weeks, e.g., 9 weeks or more, 13 weeks or more, 18 weeks or more, 6 months or more, e.g. 12 months. In other words, the expression level of the transgene does not decrease more than 100-fold, more usually not more than 50-fold, in some instances, not more than 10-fold in the 2 weeks or more, i.e. 3 weeks, 5 weeks, 7 weeks, 9 weeks or more, 13 weeks or more, 18 weeks or more, 6 months or more following transformation from levels observed within the first 1, 2, or 3 days post-transformation/transfection. In aspects of the invention, one or more promoters of constructs provided herein exhibit one or more of these features.

In one aspect, promoters of constructs comprise, PC, GCO or CO promoters or promoter/enhancer combinations that have a size (or combined size) of less than 1.25 kbs (e.g., a UBC promoter), or less than 1 kbs (e.g., an SV40 early promoter, a PGK promoter). In aspects, promoters or promoter/enhancer combinations comprise, predominantly comprise (PC), generally consist of (GCO), or consist of (CO) (PCGCOOCO) promoters that have a size of ≥0.6 kbs, ≥0.8 kbs, ≥1 kbps, ≥1.1 kbs, or ≥1.5 kbs.

In aspects, promoter(s) comprise bi-directional promoter(s) (described in, e.g., U.S. Pat. No. 5,017,478) linked to 2+ CSs.

In aspects, promoter(s) comprise a TATA-associated sequence (a so-called TATA box or Hogness box), alone or in combination with additional promoter elements. TATA-less promoters also can be suitable in some contexts. Promoters also often will include a "CAT" box sequence, which are similarly KITA. Additional examples of promoters are described in, e.g., WO 2002/00897, Werner (1999) Mamm Genome 10(2): 168-75, Walther et al. (1996) J Mol Med 74(7):379-92, Novina (1996) Trends Genet 12(9):351-55, Hart (1996) Semin Oncol 23(1):154-58, Gralla (1996) Curr Opin Genet Dev 6(5):526-30, Fassler et al. (1996) Methods Enzymol 273:3-29, Ayoubi et al (1996), 10(4) FASEB J 10(4):453-60, Goldsteine et al. (1995) Biotechnol Annu Rev 1:105-28, and U.S. Pat. No. 6,194,191. Other suitable promoters can be identified by use of the Eukaryotic Promoter Database (release 68) (presently available via the Web at epd.isb-sib.ch/) and other, similar, databases, such as the Transcription Regulatory Regions Database (TRRD) (version 4.1) (available via the Web at bionet.nsc.ru/trrd/) and the transcription factor database (TRANSFAC) (available at transfac.gbf.de/TRANSFAC/index). Additional human promoters are described in, e.g., Kim T H, Barrera L O, Zheng M, et al. Nature. 2005; 436(7052):876-880. Still further examples of promoter-related PMCs are provided in, e.g., Gray S J et al. Hum Gene Ther. 2011; 22(9):1143-1153; Xu Z L et al. Gene. 2001; 272(1-2):149-156; Magnusson T et al. J Gene Med. 2011; 13(7-8):382-391; and Romanova N et al. Biotechnol J. 2018; 13(3):e1700232.

ii. Other Regulatory Elements

NSs can AOA comprise ≥1 internal ribosome entry sites (IRESs), or RNA sequence enhancers (Kozak consensus sequence analogs), e.g., tobacco mosaic virus omega prime sequence. Internal ribosome entry sites (IRESs) are DEH.

Constructs can also comprise enhancer(s). In aspects, enhancer(s) DOS modulate expression specificity in terms of time, location, and expression level of operably linked CSs. Numerous highly effective enhancers are well known in the art (SFE Scharf D. et al. (1994) Results Probl Cell Differ 20:125-62: and Bittner et al. (1987) Methods in Enzvmol 153:516-544 for discussion). Suitable enhancers include, for example, RTE enhancers described in U.S. Pat. No. 6,225,082, and the human actin, human myosin, human hemoglobin, & human muscle creatine enhancers, which are KITA. Additional examples of enhancers include the SV40 early gene enhancer, as described in Dijkema et al., EMBO J. (1985) 4:761, the enhancer/promoter derived from the long terminal repeat (LTR) of the Rous Sarcoma Virus, as described in Gorman et al., Proc. Natl. Acad. Sci. USA (1982b) 79:6777 and elements derived from human CMV, as described in, e.g., Boshart et al., Cell (1985) 41:521 and Jeong et al., EXPERIMENTAL AND MOLECULAR MEDICINE, Vol. 34, No. 4, 278-284, September 2002. The CMV enhancer, as noted above, is often paired with promoters, such as the CAG promoter. The WT HCMV enhancer is upstream of the HCMV promoter at −598 to −68 (~600 bps). In aspects, enhancer(s), promoter(s), or a combination enhance expression of operably linked CDs 4-, 8-, 45-, 50-, and 90-fold. As is the case with the CMV promoter, the CMV enhancer is considered a "universal" enhancer, working in many cell types. Inclusion of such enhancers in constructs is an AOTI. In AOTI, constructs of comprise an enhancer. In other aspects, constructs of the invention comprise only a portion of an enhancer, such as a portion of the CMV enhancer. Both constructs comprising & lacking enhancer elements are AOTI.

In aspects, constructs comprise Ubiquitous Chromatin Opening Element (UCOE), which exhibit promoter/enhancer function(s). At least some UCOE sequences also prevent transgene silencing and induce consistent and high-level gene expression. In some contexts, a construct of the invention can comprise a UCOE or a portion of a UCOE. In some contexts, the UCOE is not integrated into the chromosome of a host when the construct is delivered. Examples of UCOEs are described in, e.g., Antoniou M N, Skipper K A, Anakok O. Hum Gene Ther. 2013 April; 24(4):363-74; Maksimenko O et al, Acta Naturae. 2015 July-September; 7(3):15-26; Nair, A. R., et al. BMC Res Notes 4, 178 (2011); and Nevillea et al., *Biotechnol Adv.* 2017; 35(5):557-564. However, in aspects, constructs are CB lacking any UCOE sequences.

Regulatory element(s) incorporated into constructs, such as plasmids, can also include element(s) that act as transcription-termination elements (aka, a transcription-termination region), a transcript-stabilizing element, a translation promoting element, or a nuclear export element, or a CT.

DNA constructs typically include a polyA sequence that facilitates cleavage and polyadenylation of expressed RNA transcripts. In aspects, the polyA sequences include the sequence motif AAUAAA. Examples of suitable polyA sequences include the polyadenylation sequences of BGH (Bovine Growth Hormone), human growth hormone gene, polyoma virus, TK (Thymidine Kinase), EBV (Epstein Barr Virus), rabbit beta globin, and the papillomaviruses, including human papillomaviruses and BPV (Bovine Papilloma Virus). Additional principles related to selection of appropriate polyadenylation sequences are described in, e.g., Chen et al. (1995) Nucleic Acids Res 23(14):2614-2620, Moreira et al. (1995) EMBO J 14(15):3809-3819, Carswell et al. (1989) Mol Cell Biol 1989 9(10):4248-4258. One example of a polyA sequence that can be incorporated into constructs and vectors is SEQ ID NO:10.

In one aspect, constructs of the invention incorporate one or more polyadenylation (polyA) sequences that detectably or significantly increase nuclear export, expression, translation, expressed mRNA stability, or a combination of any or all thereof. In one aspect, the polyadenylation sequence of the construct is one that affords an at least about 125%, at least about 150%, at least about 175%, at least about 200%, at least about 225%, at least about 250%, or at least about 275%, such as an about 125-350%, about 125-300%, about 150-300%, about 150-350%, or about 200-350% increase in expression as compared to a minimal synthetic polyA (SPA) signal in one or more target cells (SFE Levitt N et al. Genes Dev. 1989; 3(7):1019-1025 and Yew N S, et al. Hum Gene Ther. 1997; 8(5):575-584). Such polyadenylation (polyA) sequences include the SV40 (human Sarcoma Virus-40) polyadenylation sequence and the BGH polyA (bGHpA) sequence. Such polyA sequences are described in, e.g., Goodwin et al. (1998) Nucleic Acids Res 26(12):2891-8, Schek et al. (1992) Mol Cell Biol 12Q2:5386-93, & van den Hoff et al. (1993) Nucleic Acids Res 21(21):4987-8. In aspects, constructs comprise, PC, generally are associated with or only contain ≥1 polyA sequences that is CB as having a strong polyA sequence effect (e.g., a polyA having enhancement effects similar to the SV40 late polyA or bGH polyA). In another aspect, the constructs in the compositions of the invention or used in the methods of the invention comprise, primarily comprise, generally are associated with, or only contain polyA sequences that are classified as relatively weak polyA sequences, such as a SPA or a human growth hormone (hGH) poly A sequence.

A construct can have any suitable number of polyadenylation sites. Typically, each coding sequence will have a single polyA site, but the expression of pre-mRNAs with multiple polyadenylation sites are known (e.g., in the case of human vascular endothelial growth factor A (VEGF-A)) and such constructs are, in one aspect, also or alternatively incorporate multiple polyA sites.

In aspects, constructs comprise polyA modulating cis-acting regulatory elements, such as enhancer elements, e.g., polyA USE sequence(s). In AOTI, constructs comprise ≥1 polyA USE sequence(s), that DOS enhance expression of associated CS(s). The polyA signal (AAUAAA) of SV40 mRNAs, e.g., contains up- and down-stream sequences influencing efficacy of polyA signal(s) during mRNA processing. (SFE Schambach A et al. Mol Ther. 2007; 15(6):1167-1173. doi:10.1038/sj.mt.6300152 & Schek N et al. Mol Cell Biol. 1992; 12(12):5386-5393. doi:10.1128/mcb.12.12.5386). In aspects, a polyA USE increases associated CS expression, by ≥125%, 150%, 175%, or ≥200%. In aspects, constructs comprise 1, 2, or 2+ USEs & polyA(s), wherein the USE(s) DOS enhance CS expression. Exemplary USEs include the SV40 2×USE, the HIV-1 USE, the ground squirrel hepatitis virus (GHV) USE, the adenovirus (L3) USE, the human prothrombin (hTHGB) USE, & the human C2 complement (hC2) USE.

In aspects, constructs incorporate a non-polyA post-transcriptional regulatory element sequence (e.g., a sequence that acts as an alternative transcript-stabilizing and/or nuclear export element), such as a woodchuck hepatitis virus post-transcriptional regulatory element (WPRE) (SFE Zufferey R et al. J Virol. 1999; 73(4):2886-2892), a HPRE (Hepatitis B Virus PRE-SFE Huang Z M et al. Mol Cell Biol. 1995; 15(7):3864-3869), or a constitutive transport element (CTE) of the simian retrovirus type 1 (SRV-1). E.g., constructs can comprise ≥1 non-polyA post-transcriptional regulatory element sequences (e.g., non-polyA sequences that are transcript-stabilizing or nuclear export promoting elements), e.g., 1, 2, or 2+ WPREs, e.g., in association with a gDP, typically in a viral vector. In one aspect, such constructs lack any intron sequences. In one aspect, such constructs DOS enhance expression of associated CSs. In AOTI, constructs incorporating such elements are associated with ≥1.5×, at least about 2×, ≥2.5×, at least about 3×, ≥4×, or ≥5× increase in CS expression (e.g., ~2-10 or ~2.5-7.5× increase in expression). In another aspect, such a construct also or alternatively is associated with a detectably lower amount of expression silencing or a significantly lower amount of expression silencing. Other known non-polyA transcription and transcript regulatory sequences including the 5' UTR of human heat shock protein (Hsp/HSP) 70 (SFE Vivinus S et al. Eur J Biochem. 2001; 268(7):1908-1917) and the mouse RNA transport element (RTE) (SFE F. Nappi, et al., J. Virol., 75 (2001), pp. 4558-4569). Use of mammalian poly(A) signals in combination with certain viral packaging systems has been associated with reduced viral titer in some reports, but improved transcript life, such that in aspects of the invention comprising viral vectors non-poly (A) transcript-stabilizing and nuclear export elements are often incorporated in place of polyA sequences, such as a WPRE or a CTE. In aspects, a construct of the invention, such as a viral vector associated construct, can comprise a synthetic transcript-stabilizing or nuclear export element, such as a hybrid of a CTE and RTE elements, an example of which is the RTEm26-CTE element described in Smulevitch S, et al. 2006; 3:6. Fragments of such elements, such as functional fragments of WPREs are known in the art and can be incorporated into certain constructs of the invention, e.g., a construct that lacks an intron (including, e.g., a promoter or promoter/enhancer associated with an intron, such as forms of EFα1 or CAG promoters that contain introns) and is associated with a viral vector. However, in other contexts, viral vector associated constructs comprise a polyA that is a classified as a weak polyA, such as a hGH polyA or an SPA.

Elements such as a polyA, WPRE, etc. are typically located in a 3'-untranslated region (3'-UTR), which immediately follows a stop codon of an expression cassette and is not translated. In AOTI, constructs comprise a 3'-UTR. 3'-UTRs often contain elements DOS influencing gene expression, including polyadenylation, localization, stability, & mRNA translation efficiency.

Other regulatory sequences include transcription termination sequence, internal ribosome entry sites (IRES), splicing control sequences, or an upstream activator sequence (UAS), such as a Gal4 activator sequence (SFE U.S. Pat. No. 6,133,028) or other upstream regulatory sequences (SFE U.S. Pat. No. 6,204,060). NAMs can include other specific initiation signals that aid in efficient translation of a coding sequence, such as a WT or FV Kozak consensus sequence (as described in U.S. Pat. No. 6,107,477 (e.g., GCCAC-CATG, GCCACCATG, or GCCGCCACCATGG (SEQ ID NO:458)). NAMs can comprise site-specific recombination sites, which can be used to modulate transcription of NSs (SFE U.S. Pat. Nos. 4,959,317, 5,801,030 & 6063627; EP 0987326; & WO 97/09439). NAMs can contain an origin of replication that confers the ability to replicate in the desired host cells, sites to enable incorporation of other NSs (e.g., a multiple cloning site (MCS), aka a polylinker (a short NS which contains many (e.g., 2-20, 3-15, 4-12, or 4-20) restriction sites, MGAOA being unique to the construct/vector).

Constructs can also include nuclear targeting sequences (NTSs) that DOS enhance NAM delivery to the nucleus (e.g., part of the smooth muscle γ-actin promoter harbors binding sites for transcription factors improves uptake of plasmid DNA & binding sites of the transcription factor NF-κB increase expression of associated CSs when contained in cationic lipid-associated plasmid DNA). The SV40-DTS sequence also can induce active nuclear import of DNAs. Thus, In AOTI, constructs can include any of the foregoing elements, such as one or more NTSs. In other AOTI, constructs lack any NTS.

Additional regulatory elements that can DOS improve expression of heterologous genes from mammalian expression vectors include such elements as the expression augmenting sequence element (EASE) derived from CHO cells (Morris et al., Animal Cell Technology, 1997, pp. 529-534 and PCT Application WO 97/25420) and the tripartite leader (TPL) and VA gene RNAs from Adenovirus 2 (Gingeras et al., J. Biol. Chem. 257:13475-13491, 1982). The internal ribosome entry site (IRES) sequences of viral origin allow dicistronic mRNAs to be translated efficiently (Oh and Sarnow, Current Opinion in Genetics and Development 3:295-300, 1993; Ramesh et al., Nucleic Acids Research 24:2697-2700, 1996). Expression of a heterologous cDNA as part of a dicistronic mRNA followed by the gene for a selectable marker (e.g. DHFR) has been shown to improve transfectability of the host and expression of the heterologous polynucleotides (Kaufman, Meth. in Enzymology, 1990).

CS(s) of a construct and associated regulatory sequences will typically be operably linked (aka, operably associated). NSs are "operably linked" when they are associated in a manner as to DOS enhance/induce expression, or carry out other intended function(s) (e.g., enhancement of mRNA transcript stability) when the CS(s) and regulatory sequence (s) are in proper location, orientation, etc., in the NS. Placement of regulatory elements and CSs is KITA. Typically, operably linking of a promoter and CS(s) means that the promoter and transcriptional initiation or start sequence are positioned 5' to the CS, such that the promoter can carry out its intended function. A promoter is operably associated with CS(s) if the promoter DOS affects transcription of the CS(s). Other transcription control elements, besides a promoter, for example enhancers, operators, repressors, & transcription termination signals, also can be operably associated with CSs DOS modulating processes relating to transcription, delivery of NAMs to targets, etc. Regulatory elements incorporated in constructs are primarily, generally, or entirely operable in TR(s) to which they are to be administered. In the context of this invention that means in one or more alphaherpesvirus infectable vertebrates. In one context, the regulatory sequences are operable in and the expressible sequences expressible in 2+ or 3+ species. In AOTI, one of the species includes humans. In AOTI, the regulatory sequences are operable in and the sequences are expressible in one or more non-human companion or livestock animals, such as dogs, horses, or chickens. In AOTI, the sequences are expressible in is an even toed ungulate, such as a swine.

NAMs can include NSs outside of the expression cassette, such as backbone elements. Such elements can provide further possibility to improve the therapeutic efficacy of a NAM. Potentially beneficial additional NAM elements include functional regions to remove immunogenic sequences as well as sequences that mediate nuclear import of the plasmid, prolonged expression, and self-partitioning. Such aspects are DFEH or KITA.

Additional NAM elements may be positioned upstream (5') or downstream (3') of CSs/expression cassettes. Examples of such elements include UTRs, Kozak sequences, oligo(dT) sequence(s), detectable tags, or multiple cloning sites. In aspects, a 5' UTR and/or a 3' UTR region flanks the CS(s). Multiple 5' or 3' UTRs may be included in the flanking regions and may be the same or of different sequences. As DEH, regulatory element(s) can be substituted with any suitable fragment, homolog, or variant thereof, such as a codon optimized regulatory element or an FF (e.g., a minimized CMV promoter). E.g., a portion of the above-described flanking regions of a construct may be codon optimized and any may independently contain one or more different structural or chemical modifications, before and/or after codon optimization.

In AOTI, constructs comprise intron(s). Introns are KITA as NSs that when transcribed, e.g. as part of a gene, are biochemically removed ("spliced") from the transcript by the splicesome prior to translation of the transcript. Intron(s) containing splice donor and acceptor sites can be incorporated in constructs (SFE Chapman et al., Nuc. Acids Res. (1991) 19:3979-3986). In cases, an element classified as another type of regulatory element can comprise 1+ introns. E.g., both EF1α and CAG promoters can comprise intron(s). However, variants of such elements that are still functional and lack introns are also sometimes available and can be incorporated into constructs of the invention. For example, a minimized version of EF1α lacking any intron sequence is available. In some aspects, introns can be associated with detectably improved mRNA processing, increased transgene expression, or both. In AOTI, the constructs incorporate one or more introns that are associated with such other elements.

In AOTI, constructs incorporate one or more introns that are independent (separate) of any other regulatory elements.

In AOTI, constructs comprise EEI(s). Despite the significant amount of work encompassed within the Wistar Art, such disclosures provide no disclosure or suggestion that inclusion of EEI(s) is important to the performance of gDAgFP-encoding constructs. Thus, the Wistar Art does not teach or suggest any such aspect of the invention. Such aspects of the invention are further described in the following section and other portions of this disclosure.

iii. Introns/Intron-Mediated Expression Enhancement

As noted above, in AOTI constructs comprise 1+ EEI(s). An "expression-enhancing intron" is an intron associated with DOS or several-fold increase in mRNA processing, transgene expression, or both. Increased measures of expression that result from the inclusion of an expression-enhancing intron in constructs of the invention can be due to increases in the amount of mRNA expression, increased levels of translatable mRNAs in the cytoplasm, or CT. EEI(s) AOA can be CB a DOS or several-fold increased rate of nuclear export to the cytosol, transcript stability, transcription initiation, transcription re-initiation, transcript elongation, transcript accuracy, polyadenylation, or CT.

Phrases such as "several-fold increased," "several-fold improved," and "several-fold enhanced" here are used to refer to a condition, event, etc., in which the measured result (here, EEI-associated CS/EPES expression) is enhanced by at least two fold (200%), e.g., ≥3 fold (at least 300% or at least 3×), ≥four-fold, ≥five-fold, ≥six-fold, ≥seven-fold, ≥eight-fold, or at least ten-fold, at least 15-fold, at least 20-fold, or even at least 25-fold, or more, which are, e.g., levels of enhancement of expression that can be achieved with inclusion of an expression-enhancing intron in the constructs of the invention. In aspects, EEI(s) of a construct increases expression of the associated coding sequence (e.g., on average or as reflected by a median amount) by about 125% to about 750%, e.g., about 150% to about 600%, e.g., about 175% to about 600%, about 200%-about 550% or about 250%-about 550%.

Except where explicitly indicated or clearly indicated by context, "improved" herein means "increased." In some aspects, "improved" means "reduced," such as in respect of toxicity of a CEPESC.

In AOTI, constructs comprise one or more expression-enhancing introns that are part of a larger regulatory element, such as a promoter, enhancer, or combined promoter/enhancer region. One example of such a construct is a construct that comprises a CAG promoter, which is composed of a CMV IE enhancer sequence; the promoter, first exon, and first intron of the chicken beta-actin gene, and the splice acceptor of the rabbit beta-globin gene.

In aspects, constructs comprise EEI(s) that are independent of any other regulatory elements (e.g., are not part of a promoter or enhancer), at least as such elements are defined in respect of the construct (such an exclusion does not exclude placement of the intron in a 5' or 3' UTR). E.g., constructs provided herein can comprise a CMV Intron A sequence, such as SEQ ID NO:8 or SEQ ID NO:9 or a FV that is very related (VR), highly related (HR), or substantially identical (SI) (VRHROSI) to either thereof, which may be included in a construct with a CMV enhancer, e.g., SEQ ID NO: 7 or a similarly related variant thereof, a CMV promoter, e.g., SEQ ID NO:6, an FF, or a FV thereof, or both, neither of which comprises a CMV Intron A sequence.

In AOTI, constructs comprise one or more "intronic cassettes." The phrase "intronic cassette" is used to refer to a polynucleotide sequence comprising an intron as well as one or more other elements, e.g., one or more splice donor sequence(s), one or more splice acceptor sequence(s), a G triplet sequence, a pyrimidine-rich tract, a consensus branch point sequence, etc., that promote out-splicing of the intron, or combinations of any or all thereof.

A splice donor sequence, also known as a 5' splice site, is a sequence that typically flanks the 5' end of an intron, and typically comprises an AG dinucleotide. A splice acceptor sequence, also typically known as a 3' splice site, is a sequence that typically flanks the 3' end of the intron, and typically comprises a G-C dinucleotide. Any splice donor sequence and splice acceptor sequence may be used in an intronic cassette. For example, splice donor and acceptor sequences may be splice donor and acceptor sequences that flank an intron normally found in nature. Alternatively, the splice donor and acceptor sequences may be optimized splice donor and acceptor sequences, e.g., they may comprise a 5' exonic splicing enhancer (ESE) and/or a 3' exonic splicing enhancer (ESE) (SFE Fairbrother W G, et al. Predictive identification of exonic splicing enhancers in human genes. Science 297: 1007-1013, (2002)) such as ATCTTC and CTGAAG, respectively. As another example, an intronic cassette may comprise a G triplet sequence, e.g. gggccgggCCTgggccgggTCCgggccggg (SEQ ID NO:7) (McCullough A J, Berget S M (1997) Mol Cell Biol 17: 4562-4571). Intronic cassette(s) may comprise a sequence, or "tract," rich in pyrimidines, e.g, a tract of 5-20 or 8-15 pyrimidines, e.g., 10-13 pyrimidines (Coolidge C J, et al. (1997) Nucleic Acids Res 25: 888-896). Intronic cassette(s) may comprise a consensus branch point sequence (BPS), e.g. yUnAy (y being any pyrimidine, n being any nucleotide) encoded by yTnAy, e.g. CTGAC. (Gao et al. (2008) Nucleic Acids Res. 36(7):2257-2267). Intronic cassette(s) may comprise a number of sequences that exogenous to the CS, other regulatory elements, or both.

In AOTI, the constructs include 1+ EEI(s) that enhance expression even in the absence of DOS splicing. In aspects, constructs comprise one or more EEI(s) that detectably associate with U1 snRNA. In AOTI, one or more expression-enhancing introns of a construct associate with U1 snRNA and exhibit splicing-related enhancement of expression.

In aspects, constructs include at least a portion, such as at least a 5' portion, of one or more introns that are first introns in their native (i.e., endogenous, naturally occurring) sequences. CMV Intron A is an example of such an intron. First introns or FFs thereof, such as 5' fragments thereof, often can exhibit intron-mediated expression enhancement over other introns, at least with a typically DOS higher frequency of success.

In AOTI, at least one intronic cassette is operably linked to the same promoter that will mediate the expression of CS(s), e.g., a gDAgFPES. In other words, in such constructs expression cassette(s) that comprises the transgene of interest in such aspects also comprise intronic cassette(s). In such instances, intronic cassette(s) can be located in any configuration relative to the CS. E.g., intronic cassette(s) may be located upstream, or 5', of the CS, i.e., between the promoter and the initiation codon for the CS. As another example, intronic cassette(s) may be located within a transgene, i.e., flanked by two exons of a CS. As another example, the intronic cassette may be located downstream of the transgene, e.g., if the transgene does not comprise a termination sequence, the intronic cassette may be placed downstream of the transgene coding sequence and upstream of an exogenous termination, e.g., polyadenylation, sequence. As another example, the intronic cassette may be separated from the transgene by an IRES sequence. In other instances, the intronic cassette of the subject vectors is under the transcriptional control of a promoter that is different than the promoter that will mediate expression of the transgene. In other words, the expression cassette that comprises the intronic cassette may not comprise the transgene of interest, but rather, will be a separate expression cassette from the one that comprises the transgene.

An example of an expression-enhancing intron that can be incorporated/used in constructs of the invention is the EF-1α first intron, which is described in, e.g., Lee, C., Ko, A. M., Chiang, S. et al. Regulatory elements in vectors containing the ctEF-1α first intron and double enhancers for an efficient recombinant protein expression system. Sci Rep 8, 15396 (2018). Another expression-enhancing intron is the SV40 intron (SFE Xu, D.-h., Wang, X.-y., Jia, Y.-I., Wang, T.-y., Tian, Z.-w., Feng, X. and Zhang, Y.-n. (2018), SV40 intron, a potent strong intron element that effectively increases transgene expression in transfected Chinese hamster ovary cells. J. Cell. Mol. Med., 22: 2231-2239). Additional expression-enhancing introns that might be included in constructs of the invention include the MVM intron (minute virus of mice) and the human factor IX intron and variants thereof, such as truncation variants (SFE Kurachi S, Hitomi Y, Furukawa M, Kurachi K. Role of intron I in expression of the human factor IX gene. J Biol Chem. 1995; 270(10): 5276-5281). Synthetic/artificial expression-enhancing introns also are known in the art and can be incorporated into constructs (see., e.g., Lu J, Williams J A, Luke J, Zhang F, Chu K, Kay M A. A 5' Noncoding Exon Containing Engineered Intron Enhances Transgene Expression from Recombinant AAV Vectors in vivo. Hum Gene Ther. 2017; 28(1): 125-134 and Lu J, Zhang F, Kay M A. A mini-intronic plasmid (MIP): a novel robust transgene expression vector in vivo and in vitro. Mol Ther. 2013; 21(5):954-963). The use of expression-enhancing intron IV of the human NPY receptor Y1 and variants thereof also has been described in the art and also or alternatively can be used in some constructs of the invention. SFE WO2000063404.

In AOTI, EEI(s) comprise hybrid intron(s). Expression-enhancing hybrid introns include the adenovirus SD intron/Immunoglobulin heavy chain SA intron, the β-globin SD/immunoglobin heavy chain SA intron, & the SV40 late SD/SA intron (SFE Yew N S et al. Hum Gene Ther. 1997; 8(5):575-584 and Wu Z, et al. Mol Ther. 2008; 16(2):280-289). Another such expression-enhancing intron is the βGI-IgG intron (SFE US 20110217695).

In AOTI, EEI(s) comprise CMV intron(s). In AOTI, EEI(s) comprise HCMV Intron A, an FF, or a FV (e.g., a highly related, closely related, or substantially identical variant thereof) (a "CMV Intron A sequence"). For example, a CMV Intron A sequence can comprise a deletion variant, wherein 10-600 nt of the WT Intron A sequence are removed. In AOTI, the CMV Intron A variant exhibits increased expression-enhancement as compared to EL WT CMV Intron A. An example of such a CMV Intron A deletion variant ATAOTI is described in, e.g., Quilici L S et al. Biotechnol Lett. 2013; 35(1):21-27. In AOTI, constructs comprising only a single intron are provided. In some cases, only one CMV intron is included in a construct. In one example, the only intron sequence in the construct is a CMV Intron A sequence (or "Intron A sequence"). In AOTI, at least a portion of the CMV IE first exon is also included in a construct. In AOTI, the CMV IE first exon or portion thereof is the only CMV IE exon in the construct. In AOTI, such a construct comprises a CMV promoter, CMV enhancer, or both, as well as an Intron A sequence. In AOTI, constructs comprise a promoter that is at least partially heterologous to the CMV Intron A sequence, such as an RSV promoter or a CAG promoter. Examples of such constructs are described in U.S. Pat. No. 6,893,840 & US20120142056. EEIs are further described in, e.g., Buchman et al., Molec. Cell. Biol. (1988) 8:4395-4405; Chapman et al., Nuc. Acids Res. (1991) 19:3979-3986; & Simari, R. D et al. Mol Med 4, 700-706 (1998).

Constructs can comprise a CMV promoter, DEH, and 1+ introns heterologous to CMV. E.g., constructs can comprise NS(s) in which Intron A of CMV is substituted with a heterologous intron. Examples of such constructs are described in, e.g., US20090130126. Constructs comprising a CMV Intron A sequence may include CMV IE exons, such as all or part of exon 1 or exon 2. Examples of such constructs comprising a CMV promoter and heterologous introns are described in, e.g., Nott A et al. RNA. 2003; 9(5):607-617.

In AOTI, ≥1 intron/EEI is located 5' to the associated coding sequence. In AOTI, ≥1 intron/EEI is also or alternatively located 3' to the end of the associated coding sequence. In AOTI, at least one intron/EEI is contained with a CS. In AOTI, at least one, most, generally all, substantially all, or all of the introns included in the construct are located within 1-200 nt, such as 1-100 nt, 1-75 nt, 1-60 nt, 10-60 nt, 20-60 nt, 30-60 nt, 25-55 nt, 35-55 nt, or 5-55 nt of the coding sequence (sequence end to sequence end).

In AOTI, constructs comprise ≥2 introns/EEIs. In AOTI, constructs AOA comprise at least one intron that is positioned internal to a coding sequence. For example, in one aspect the invention provides a construct comprising a sequence according to the formula intron1-gD-encoding sequence 1 (gD1) (coding for an N-terminal fragment of gD or a variant thereof)—coding sequences for antigenic sequence(s)—gD encoding sequence 2 (gD2, a C-terminal gD fragment or variant thereof)—intron 2-gD3 (corresponding to a second gD1 sequence, which may be the same or different from the first gD sequence)—antigenic sequence(s) coding region 2.

iii. Scope of Referenced Regulatory Elements and Variations in Definitions Thereof As KITA, there is variability in the usage of terms such as promoters and enhancers ITA and either or both types of elements can comprise expression-enhancing introns depending on such definitions. Thus, for example, it may be possible to characterize a sequence as a promoter while others skilled in the art may characterize the sequence as comprising, e.g., a promoter & enhancer or promoter & intron. For example, SEQ ID NO:5 comprises a sequence described as a CMV promoter incorporated into exemplary plasmids used in the Examples of TD, but this sequence has significant overlap with SEQ ID NO:6 and SEQ ID NO:7, identified as comprising the CMV promoter and enhancer sequences, respectively (SFE snapgene.com). As another example of the possible variation in the definition of well-known regulatory elements, GenBank Accession No. M60321 defines CMV Intron A as corresponding to SEQ ID NO:8, whereas in the exemplary plasmids provided in the Example CMV Intron A is identified as associated with SEQ ID NO:9, which overlaps (is identical to) SEQ ID NO:8 for 825 nt (of 956 nt). Unless explicitly stated or clearly contradicted herein, all known functional forms of the referenced regulatory element herein are to be considered included by the reference, as well as FVs thereof that are related, very related, highly related, or substantially identical (RVRHROSI) to any such known forms of the referenced regulatory element(s). E.g., references to CMV Intron A herein include SEQ ID NO:9, SEQ ID NO:8, and FVs thereof that act as EEIs and are RVRHROSI to either SEQ ID NO:8, SEQ ID NO:9, or both sequences. Still other authors characterize CMV as comprising a "promoter/enhancer region" comprising binding sites for several different transcription factors, a complex enhancer, four exons, and three introns, intron A being the largest thereof. SFE Chapman et al., *Nuc. Acids Res.* (1991) 19:3979-3986 for the sequence and structure of this region in hCMV strain Towne, and Akrigg et al., *Virus Res.* (1985) 2:107-121, for a description of the corresponding region in hCMV strain AD169. Still others ITA describe the use of HCMV IE1 "minimal promoters," which may be, e.g., defined as a fragment of the HCMV IE1 promoter region capable of functioning as a promoter, driving transcription from the natural transcription start site (e.g., a fragment of the HCMV IE1 gene comprising nucleotides −116 to +1 (the HCMV IE1 transcription start site)). Thus, references to a CMV promoter or enhancer, e.g., can be construed as alternatively but simultaneously and implicitly encompassing all of these elements, generally, but also specific portions of such elements as defined by, e.g., the specific CMV promoter and enhancer sequences referenced in this paragraph or DEH (including in the various references incorporated herein).

2. Other Non-Coding Sequences

NSs can comprise other types of non-coding nucleotide sequences besides regulatory elements. For example, where a nucleotide sequence is a vector the nucleotide sequence can include "backbone" sequences, as DEH. Non-coding sequences also can include restriction enzyme sites, also DEH.

a. Immunostimuatory Nucleotide Sequences

One type of noncoding sequence that can be incorporated into NAM(s) of CEPESC(s) is a noncoding immunostimulatory nucleotide sequence (ISNS). Examples of ISNS KITA include sequences that exhibit a CpG or UpA nucleotide pattern. Typically, ISNS(s) induce DOS IR(s) in TR(s).

In AOTI, CEPESCs comprise CpG sequence(s) recognized by IC(s), e.g., innate IC(s) or ITIC(s), e.g., by binding an ICR or an innate trained immune cell receptor (ITICR). In AOTI, a CEPESCs include NAM(s) comprising CpG NS(s) that binds a DC receptor (DCR). In AOTI, the dendritic cell receptor (DCR) is DEC-205. In AOTI, NAM(s) comprise class B CpG ODN. In AOTI, CpG sequence(s) in NAM(s) DOS enhances uptake of the NAM by ITICs, e.g., DCs. In one such aspect, the NAM is optionally associated with a transfection-facilitating agent (TFA), such as a calcium phosphate (CaPNP) nanoparticle, which also or alternatively can detectably or significantly enhance uptake of the nucleic acid by DCs. Examples of such CpG ODNs are described in, e.g., Lahoud M H et al. Proc Natl Acad Sci USA. 2012; 109(40):16270-16275.

CEPESCs AOA can include UpA-rich nucleotide sequences that can DOS induce IR(s), reduce NAM stability, or both. Such sequences are described in, e.g., Fros J J et al. Elife. 2017; 6:e29112. Additional types of immunostimulatory NSs that can be incorporated into CEPESCs are KITA. Examples include AU-rich sequences, CA- and CT-repeat sequences, (GTA)CATCC(CTA) motif sequences, U(C/G)U or U(U/A)N and (A/U)CG(A/U) motifs, U-rich RNA sequences, GAAAGACC motifs, and (C/T)(A/T)TTGT(T/C)ATG CAAAT motifs. SFE Vabret N et al. Trends Immunol. 2017; 38(1):53-65. Related PMCs are described in, e.g., Mutwiri G, et al. Adv Drug Deliv Rev. 2009; 61(3):226-232; Tanne A et al. Proc Natl Acad Sci USA. 2015; 112(49): 15154-15159; Verfaillie T et al. Vet Immunol Immunopathol. 2005; 103(1-2):141-151; Coban C et al. J Leukoc Biol. 2005; 78(3):647-655; Klinman D M, et al. Immunol Rev. 2004; 199:201-216; Reidel I G et al. Vet Immunol Immunopathol. 2019; 212:1-8; & Ito H et al. J Viral Hepat. 2017; 24(2):155-162. Additional PMCs ATAOTI are described in, e.g., U.S. Pat. Nos. 8,871,436, 9,522,958, 8,968,749, 9,566,292, & 10202606; US Patent Publication Nos. US20190134190, US20190100756, US20180264105, US20200085931 & US20110300164; International Patent Application Nos. WO2016152767, WO2018179172, & WO2019160866; Australian Patent Application AU2019200943A1; & Chinese Patent Applications/Patents CN106490361, CN108486120, CN103127501, CN103435690, CN109091671, CN109350739, CN110042103,&CN110218729.

b. Other Sequences Effecting Expression and Expression Products

In aspects, NS(s) can comprise one or more sequences that impact expression or expression products, but which may not be traditionally or ordinarily considered regulatory elements. Examples of such sequences include splicing-related sequences, internal ribosome entry sites (IRESs-SFE Gritsenko A A et al. PLoS Comput Biol. 2017; 13(9): e1005734, etc. Examples of such NS are DEH.

One example of such a sequence is a scaffold/matrix attachment region (S/MAR). S/MARs can be incorporated into DNA sequences, such as DNA vectors, to facilitate a once-per-cell-cycle replication to maintain the vector as an episome in daughter cells. Typically, to confer function as an episome, an S/MAR sequence will be encoded downstream of an actively transcribed gene. E.g., a ~2 kb S/MAR from the human β-interferon gene cluster, can generate a persistent non-integrating lentiviral vector in dividing cells. In AOTI, a S/MAR-containing nucleic acid vector, such as a minicircle vector, can result in an increase in stably maintained transfected cells after ≥10, 30, 40, 45, 50, 60, 75, or even ≥90 days or more post transfection, of at least about 25%, at least about 33%, at least about 50%, at least about 2× (100%), at least about 3×, at least about 5×, at least about 10×, at least about 15×, or even at least about 20× cells (compared to control). Similarly, constructs can comprise viral replication genes KITA that similarly confer the ability of an associated NAM to replicate in certain cells.

Additional examples of noncoding sequences include nuclear localization signals, ribosome binding sites, and insulators (sequences that allow for binding of transcription-related proteins, such as proteins that prevent structural changes in the associated nucleic acid or that otherwise control transcription). Any combination of such sequences AOA can be included in NAMs. Examples of such sequences are KITA.

c. Nucleotide Sequence Spacers

NAMs can comprise NSs that at least in part exhibit no function other than creating space between other NSs. Such "spacer" sequences can comprise elements that exhibit regulatory sequence functions, exhibit other functions, or that are nonfunctional besides separating NSs. Examples of such sequences include, e.g., 3' and 5' untranslated regions (UTRs), DEH. However, whether such a spacer sequence comprises one or more functional sections or not, spacer sequences can sometimes be associated with effects such as enhanced expression, nucleic acid stability, and the like, merely by the presence of the spacer sequence. NAMs can comprise any suitable number of noncoding regions/spacers, such as UTRs or more intergenic spacers (IGSs) located between CSs/expression cassettes in a NAM. Each spacer can be, e.g., about 10-1000 nt, e.g., ~20-800 nt, e.g., ~30-600 nt, ~40-400 nt, or about 50-250 nt, but longer or shorter spacers also can be acceptable.

Additional examples of noncoding/spacer NSs include nucleic acid vector backbones and also "stuffer sequences," which are noncoding sequences used to achieve a certain size of vector for efficient packing, such as in adenoviral vectors. Stuffer sequences can comprise, e.g., 1-10 kb of noncoding sequences, such as 2-10, 2-7, or 2-5 kb of noncoding sequences.

3. Coding Sequences (CSs) and Expression Products (EPs)

NAM(s) of CEPESC(s) comprise CS(s)/EPES(s). A "coding sequence" (sometimes abbreviated CDS, aka a "coding region") means a portion of a NAM which comprising codons translated, directly (in the case of mRNA), or indirectly (in the case of DNA), into AARs. Most CSs result in production of PPTs, though DNAs can in some cases AOA produce RNA end products. Typically, terms such as "express" or "expression" typically refers to the process to produce an RNA or PPT, including transcription and translation.

Although a "stop codon" (TAG, TGA, or TAA) is not translated into an AAR, it may be considered part of a coding region, but typically any flanking sequences, for example promoters, ribosome binding sites, transcriptional terminators, and the like, which may be part of the construct, are not considered part of the CS. Most coding regions are derived from and share similarity to genes, which are usually defined as heritable, usually organism genomic protein-coding sequences. However, the usage of "gene" has often been extended in the art to encompass synthetic coding sequences and other gene-like structures. As such, the term "gene" and related terms such as "transgene" herein should be understood as typically being synonymous with a coding sequence, unless otherwise indicated or clearly contradicted.

Another related term that often is similarly used in the art, but that sometimes differs in scope, is "open reading frame" (abbreviated "ORF"). Where not otherwise indicated, the term ORF herein also should be construed as equivalent to a CS, though there are cases where an ORF may not actually be a CS. An ORF is typically construed as a contiguous stretch of codons flanked by an in-frame start codon on the 5' side and an in-frame stop codon at the 3' side. In this respect, an ORF is similar to a CDS; however, an ORF may or may not encode a PPT (e.g., an ORF may not be preceded by the appropriate translation initiation signals or in the case of DNA-encoded ORFs, transcriptional signals). The concept of an ORF was developed as a means for identifying genes, but, as indicated, an ORF does not necessarily correspond to a CDS. That said, because the terms are often used interchangeably, ORFs should be, unless indicated otherwise, herein construed as being equivalent to a CDS.

No part of the disclosure is intended to limit the scope of any of these terms as they might be understood in the art. Numerous complicating factors extend the ability of coding sequences, ORFs, and genes in ways that do not correspond to typical descriptions provided above. For example, a DNA coding sequence can lead to the production of an RNA, which may not be translated to a polypeptide, but still can act as a functional biomolecule in a cell. Moreover, because there can be different reading frames, it is possible for a sequence to comprising overlapping ORFs and CDSs. Also, noncoding sequences, such as introns, add another layer of complexity, in that an ORF at an RNA level may only exist at the level of a processed (spliced) mRNA. In this context, an mRNA level ORF can be equivalent in some cases with an exon (a region of an immature mRNA that is retained after splicing). Even processed exons & such mRNA ORFs are not necessarily CSs.

As stated above, coding sequences are sequences that encode a polypeptide. Terms such as "protein," "peptide," and "polypeptide" (PPT) herein typically mean any peptide-linked chain of at least 2 AAs (typically at least five, ≥6, ≥7, or ≥8 AAs), joined to each other by peptide bonds or modified peptide bonds. Thus, as used herein, the terms refer to both short polymers (chains) of AARs, which are also commonly referred to in the art as peptides, oligopeptides, & oligomers, for and to longer chains of amino acid residues, which generally are referred to in the art as polypeptides or proteins. Proteins can include one chain or multiple associated chains. Thus, in a general sense "polypeptides" discussed herein can include, for example, homodimers, or heterodimers. A subunit of a polypeptide can be considered a "sequence," "region," or "domain," of a PPT. In contexts, the term "domain" is used to identify distinct part of a polypeptide having one or more unique functional or structural properties, such as a tertiary structure. However, unless specifically indicated usage of the term "domain" herein should be construed identically with "amino acid sequence" (which is often simply shorted to "sequence" where context is clear that the sequence is a chain of amino acid residues).

As DEH, CSs contained in a single CDS/ORF, associated with the same regulatory elements, also can be described as being "operatively linked." Such operatively linked NSs may be directly linked, i.e., the 3' end of the first polynucleotide is directly adjacent to the 5' end of the second sequence with no intervening nucleic acids. Alternatively, 2+ CSs of a construct may be indirectly linked by intervening NTs/NSs. E.g., intervening NSs may be noncoding or may encode an amino acid sequence, for example a peptide linker, DEH.

PPT EPs may undergo processing in cells of expression (COEs). Unless otherwise stated or indicated, any PPT/AARS described herein will comprise all forms of the AARS/PPT WRT possible posttranslational modifications (e.g., acetylation, phosphorylation, glycosylation, sulfatation, amidation, proteolysis, sumoylation, prenylation, etc.). In AOTI, post-translational site(s) are removed in FVs of referenced WTC PPTs, as DEH. As indicated in the Principles of Construction, terms such as "polypeptide" used herein should be understood to include both the singular "polypeptide" as well as plural "polypeptides." A single coding sequence may result in 2, 3, 4 or more separate PPTs due to processing. AOTI comprising CSs processed to produce separate PPTs are provided & DFEH.

In aspects, ≥2 CSs, such as ≥3 CSs, are present in a single NAM, e.g., on a single plasmid. In aspects, ≥2 CSs are in different constructs in a single CEPESC, e.g., on separate (different) plasmids. Both types of CEPESCs are AOTI, as will be clear from other portions of this disclosure. Most PPTs in compositions/methods OTI are produced by recombinant technology.

Amino acids that make up polypeptides and amino acid sequences described herein can be referred to herein by either their commonly known three letter symbols (e.g., "Gly" for glycine) or by the one-letter symbols recommended by the IUPAC-IUB Biochemical Nomenclature Commission (e.g., "A" for alanine). Thus, the 20 natural amino acids and their abbreviations follow conventional usage herein. The amino acid sequences and polypeptides disclosed herein will typically consist of, consist essentially of, substantially consist of, or generally consists of natural amino acid residues.

However, stereoisomers (e.g., D-amino acids) such as a,a-disubstituted amino acids, N-alkyl amino acids, lactic acid and other unconventional amino acids may AOA be suitable components for the polypeptides and sequences disclosed herein and, where suitable, replace indicated related AAs. Examples of unconventional amino acids include but are not limited to selenocysteine, citrulline, ornithine, norvaline, 4-(E)-butenyl-4(R)methyl-N-methyl-threonine (MeBmt), N-methyl-leucine (MeLeu), aminoisobutyric acid, statine, N-methyl-alanine (MeAla). Amino acid residues of a sequence or polypeptide also or alternatively can be substituted by suitable acid analogs, derivatives, and amino acid mimetics that function in a manner similar to the naturally-occurring amino acids (e.g., e.g., hydroxyproline, y-carboxyglutamate, and O-phosphoserine, homoserine, norleucine, methionine sulfoxide, and methionine methyl sulfonium). Sequences and polypeptides described herein with respect to naturally occurring amino acid residues will be understood as providing simultaneous disclosure for variants in which any suitable number of such naturally occurring amino acid residues are replaced with amino acid derivatives, analogs, mimetics, or unconventional amino acid residues. PPTs also can comprise, where suitable, synthetically derived derivatives of referenced PPTs, e.g., PEGylated derivatives, & other derivatives.

As most AOTI relate to constructs, AAs that make up PPTs encoded by such constructs will typically be those that are available for translation and, thus, typically GCO, SCO, or consist of naturally occurring amino acid residues. Methods also have been recently developed for the incorporation of rare amino acids other than the twenty naturally occurring amino acids that are nonetheless produced by recombinant expression (SFE WO2018039438A1).

In some aspects, PPTs described herein may be components of useful compositions or used in methods. In such aspects, derivatized amino acids, such as those described above, may be incorporated into such PPTs.

In aspects, it can be useful to number PPTs or AARSs of CEPs/compositions in order to distinguish such sequences or polypeptides. As such, terms such as "first amino acid sequence" & "second amino acid sequence" in description of a PPT or otherwise are not meant to require a specific order of the sequences in orientation, time of expression, etc. As is also the case with NAMs, discussion of "different polypeptides" or "different amino acid sequences" will be understood not to mean actual individual molecules or sequences, unless clearly indicated, but, rather, refer to individual types of such molecules or sequences, which can and typically will be present in at least hundreds, thousands, tens of thousands, hundreds of thousands of copies, or even more copies in the relevant composition.

i. Naturally Occurring Sequences

In AOTI, ≥1, at least some, primarily most, generally all, substantially all, or all NSs of a CEPESC (a) encode PPT(s) that are "naturally occurring," (b) are "naturally occurring" polynucleotide sequences, or both.

As used herein, terms such as "naturally occurring" or "naturally-occurring" as applied to a sequence or biomolecule (e.g., a polynucleotide or polypeptide), refer to a sequence or a molecule having a sequence, respectively, that occurs naturally (i.e., in natural organisms). E.g., a NS encoding a naturally occurring gD sequence means a nucleotide sequence that expresses a gD sequence that occurs in alphaherpesviruses that occur naturally (e.g., a nucleotide sequence that encodes a gD polypeptide sequence found in a herpes simplex virus, e.g., HSV-1 or HSV-2).

The term "naturally occurring" also can be applied to fragments (FFs) of biomolecules found in nature and, accordingly, reference to a "naturally occurring" or WT sequence should be understood, unless contradicted by context or explicit indication, to encompass any suitable fragment of such a referenced biomolecule, examples of which are provided in this disclosure (e.g., a naturally occurring HVEM-binding sequence/domain of a HSV-1 gD). Terms such as "wild-type" (sometimes "wild type"), natural, or endogenous are similarly used here and, accordingly, should be interpreted similarly. However, "wild type" sequences do not have to be obtained from natural sources, but, rather, encompass any sequences that correspond in composition to a sequence that occurs in nature, whether or not such sequences are synthetic or produced by synthetic materials or comprised within synthetic constructs, such as from recombinant or synthetized polynucleotides.

ii. Variants

In general, for any referenced polypeptide, polynucleotide, or sequence thereof described or referenced herein, functional fragments, functional variants (ORT as FVs or variants), and homologs of such polypeptides or polynucleotides, and sequences, can be used in place of referenced biomolecules/sequences. Accordingly, any referenced biomolecule or sequence herein should be interpreted as also implicitly disclosing corresponding aspects in which any suitable homolog, functional fragment, or variant thereof are incorporated or used in place of the referenced biomolecule or sequence.

Suitability of FFs, variants/FVs, or homologs is typically determined by composition/structure as a referenced biomolecule or sequence, maintenance of some or all of the functions of the referenced biomolecule or sequence, at an appropriate level, and usually both. Functional aspects of FVs and FFs that define suitability are discussed below and such considerations are used in the art in defining homologous sequences (e.g., what sequences should be characterized as alphaherpesvirus glycoprotein D sequences).

Unless otherwise indicated any reference to a PPT, NS, or AARS here should be understood to also include FVs/variants of the referenced polypeptide or sequence (each of which being usually just referred to as a "variant" or FV), even though in many parts of this disclosure there is explicit reference to variants of certain polypeptides and sequences.

A "variant" ("functional variant" or FV) means a PPT, NS, NAM, or AARS which is substantially similar in structure and at least similar in one or more respects in terms of biological activity to a referenced protein, domain, or sequence. Polypeptide variants and amino acid sequence variants include PPTs and AARSs, respectively, that differ from a native form of a polypeptide or amino acid sequence because of one or more deletions, insertions, or substitutions of amino acid residues. Substitutions may further be defined as conservative or unconservative substitutions, as described further below.

Variants herein encompass synthetic/artificial sequences that are similar to one or more WT sequences and typically the term "variant" will refer to such sequences. However, in some cases, as will be exemplified below, the scope of what defines suitable variants can include FFs and vice versa.

Because the function of biomolecules, particularly for polypeptides and amino acid sequences, the degree of "identity" between constituents of sequences (nucleotides or amino acid residues) in an optimal alignment is KITA as a suitable indicator of relatedness in defining a reasonable scope for variants that can be reasonably expected to exhibit suitable, similar, or improved function(s). FVs will typically exhibit a level of identity to the reference sequence(s) to at least be considered related (as defined below), if not very related, highly related, or substantially identical. Alternatively, the scope of suitable variant PPT/AARS can be defined based on "similarity" in the composition of AARSs. Specifically, variants will typically have a sequence that AOA is "similar," if not very similar, highly similar, or compositionally equivalent (as defined below). Thus, polypeptides and amino acid sequences specifically described in connection with AOTI (e.g., human EAT-2), will be understood to simultaneously implicitly disclose FVs defined by identity (being at least related or very related (VR), highly related (HR), or substantially identical (OSI) (VRHROSI)) or similarity (by being at least similar or very similar (VS), highly similar (HS), or compositionally equivalent (OCE) (VSHSOCE)), except where explicitly contradicted. E.g., description of a construct encoding human EAT-2 also implicitly discloses constructs encoding FVs of EAT-2 that are RVRHROSI to human EAT-2 and variants that AOA have sequences that are similar (S), very similar (VS), highly similar (HS), or compositionally equivalent (OCE) SVSHSOCE to human EAT-2, and which, in either case, exhibit 1+ EAT-2 function(s) at a suitable, similar, or improved level in TR(s). Thus, references to specific PPTs here, e.g., CMV intron A, human EAT-2, HSV-1 gD, HSV-2 gD, and the like, also implicitly encompass FVs (and FFs) of such referenced PPTs. In general, In AOTI, any of the named elements of the invention can be replaced by a FV that exhibits at least one corresponding function to a referenced biomolecule in a functionally relevant, such as clinically relevant, manner, and exhibit a similar composition, e.g., by being characterizable as having a sequence related (R), very related (VR), highly related (HR) (RVRHR) or SI in terms of identity to the referenced PPT, NAM, AARS, or NS or that for a PPTs/AARS is characterizable as similar (S), very similar (VS), highly related (HR) (SVSHR) or SCE to the referenced PPT or AARS. Thus, for example, the disclosure of a gD sequence herein made with reference to, e.g., a WT gD, such as HSV-1 gD or HSV-2 gD, will be understood as encompassing variants thereof, such as variants that are RVRHR or SI to the referenced AARS and that maintains OSMOA functions thereof (discussed below). Also included within the scope of acceptable variations for referenced gDS(s) are gD(s) that are similar (S), very similar (VS), highly similar (HS) (SVSHS) or SCE to a referenced gDS(s). Such FVs are exemplified below and constructs, compositions, and methods/compositions comprising such FVs constitute aspects of the invention.

Readers will also understand that any reference to a PPT, AARS, NAM, or NS herein similarly also implicitly provides corresponding disclosure for incorporation or use of a FF thereof. Fragments will typically exhibit 100% local identity to a referenced sequence. FFs will typically be large enough to provide suitable, comparable, or, in some cases, even improved functioning WRT to the EL WT referenced biomolecule/sequence. In aspects, FFs comprise ≥33%, ≥50%, ≥65%, ≥75%, ≥80%, ≥85%, or ≥90% of a EL WT biomolecule. However, in some aspects, as in the case of Ag(s), an FF can comprise only a small portion of an entire expression product (e.g., ~5%, ~7.5%, or ~10%).

Reference to a PPT, AARS, NAM, or NS also implicitly provides support for aspects AOA including suitable homologs of the referenced sequence/molecule. Suitable homologs, however, often do not exhibit relatedness or similarity to referenced biomolecules/sequences, as DEH.

The degree of identity between 2+ NSs and 2+ AARSs is indicative of relatedness between such sequences. However, changes in the nucleotide sequence of a nucleotide sequence variant may not alter an encoded AARS due to genetic code degeneracy. As such, at least with CSs, relatedness of NSs may not be required to define what is a suitable substitution WRT WT NSs.

Examples of DIVs, such as GSRVs, are exemplified below WRT antigen sequence variants (AgV(s)) that can be applied to any AARS in CEPs. E.g., gDS(s), ITII(s), NGDCI(s), NANCIPI(s), PTPS(s), and other AARS(s) also can comprise DIVs (e.g., GSRV(s)). Other variations in such non-Ag AARSs can be made to change or enhance AARS functions.

a. Enhanced NS Variants (e.g., Codon Optimized NS Variants)

In aspects, constructs comprise NS variants with enhanced properties/function(s), e.g., in terms of stability, expression, and the like. Thus, for example, in AOTI 1+ CSs, regulatory elements, or both, are optimized in terms of, e.g., resulting in detectably or significantly enhanced expression, typically significantly or clinically improving the functionality of the sequence/NAM (in the context of the present invention promoting, inducing, or enhancing an immune response). In AOTI, such enhancement is achieved through modifying a secretion signal (discussed further below), using codons for the most abundant transfer RNA (tRNAs) (codon optimization, discussed below), reducing impeding secondary structures on the resulting mRNA, introducing one or more expression-enhancing introns (a feature of the invention discussed in detail below), a combination thereof, or a combination of some or all thereof with various similar methods described in this disclosure, such as the inclusion of expression-enhancing regulatory elements, such as a strong promoter. In AOTI, such enhancement is further achieved through, e.g., increasing the number of genes encoding a polypeptide in a construct or composition (to two or more copies); increasing the transcription of the gene (such as by placing the gene under the control of a constitutive promoter, strong promoter, universal promoter, or a promoter that exhibits a combination of some or all of such features); increasing the translation of the gene through various methods described herein (e.g., association with an EEI, an enhancer, or a combination thereof); or a combination of these or other approaches.

In aspects, NS(s) AOA include other functionality-enhancing variations, e.g., variations that bias GC content to DOS increase mRNA stability or reduce secondary structures; minimize tandem repeat codons or base runs that may impair gene construction or expression; customize transcriptional and translational control regions; insert or remove protein trafficking sequences, remove/add post translation modification sites in encoded protein (e.g. glycosylation sites); add, remove or shuffle protein domains; insert or delete restriction sites; modify ribosome binding sites or mRNA degradation sites, to adjust translational rates or promote proper folding of EPs; or to reduce or eliminate problem secondary structures within the polynucleotide. In AOTI, the constructs of the invention comprise one or more codon optimized sequences that exhibit detectable improvements in one or more of such features.

In AOTI, optimization of a sequence comprises codon optimization of one or more parts of NS(s). As is KITA deviations CSs and regulatory element NSs are possible without changing the EP AW the CS. Regulatory sequences and codons, however, are both generally species dependent, so in order to maximize expression codons of CSs are preferably selected to be effective in TR(s). In AOTI, constructs comprise one or more codon optimized sequences for TR(s) (e.g., dogs, pigs, or humans), wherein the codon optimized sequence DOS increases expression; detectably or significantly reduces silencing or blocking of expression; or both.

Given the large number of gene sequences available for a wide variety of animal species, it is possible to calculate the relative frequencies of codon usage. Codon usage tables are readily available, for example, at the "Codon Usage Database" available at kazusa.or.jp/codon/ (Jul. 9, 2002), and these tables can be adapted in a number of ways. See Nakamura, Y., et al, Nucl. Acids Res. 28:292 (2000). Codon optimization tools, algorithms and services also are KITA, non-limiting examples include services from GeneArt (Life Technologies) or DNA2.0 (Menlo Park Calif.).

Any codon optimized sequence can be optimized to one or more degrees, for example a sequence can be "fully optimized" or "minimally optimized." In AOTI, constructs comprise NSs having a different degree of codon optimization, either within a single construct, between constructs, between compositions, or between compositions and administrations. Alternating the amount of codon optimized sequences contained in a construct or composition or used in a method can result in optimized long-term results.

In aspects, NS(s) are subject to full optimization. When using the "full optimization" method, the term "about" is used to account for fractional percentages of codon frequencies for a given AA. As used in this respect "about" is defined as 1 AA more or 1 AA less than the value given. The whole number value of AAs is rounded up if the fractional frequency of usage is 0.5 or greater and is rounded down if the fractional frequency of use is 0.49 or less. Using again the example of the frequency of usage of leucine in human genes, for a hypothetical polypeptide having 62 leucine residues, the fractional frequency of codon usage would be calculated by multiplying 62 by the frequencies for the codons. E.g., 7.28% of 62 equals 4.51 UUA codons, or "about 5," i.e., 4, 5, or 6 UUA codons, 12.66% of 62 equals 7.85 UUG codons or "about 8," i.e., 7, 8, or 9 TUG codons, 12.87% of 62 equals 7.98 CUU codons, or "about 8," i.e., 7, 8, or 9 CTU codons, 19.56% of 62 equals 12.13 CUC codons or "about 12," i.e., 11, 12, or 13 CUC codons, 7.00% of 62 equals 4.34 CUA codons or "about 4," i.e., 3, 4, or 5 CUA codons, & 40.62% of 62 equals 25.19 CUG codons, or "about 25," i.e., 24, 25, or 26 CUG codons.

In AOTI, NS(s) are minimally optimized. In a "minimal optimization" approach, coding regions are only partially optimized. For example, the invention includes a nucleic acid fragment of a codon-optimized coding region encoding a polypeptide in which at least about 1%, 2%, 3%, 4%, 5%, 10%, 15%, 20%, 25%, 30%, 35%, 40%, 45%, 50%, 55%, 60%, 65%, 70%, 75%, 80%, 85%, 90%, 95% or 100% of the codon positions have been codon-optimized for a given species. That is, they contain a codon that is preferentially used in the genes of a desired species, e.g., a vertebrate species, e.g., humans, in place of a codon that is normally used in the native nucleic acid sequence. Codons that are rarely found in the genes of the vertebrate of interest are changed to codons more commonly utilized in the coding regions of the vertebrate of interest. This minimal human codon optimization for highly variant codons has several advantages, which include but are not limited to the following examples. Because fewer changes are made to the nucleotide sequence of the gene of interest, fewer manipulations are required, which leads to reduced risk of introducing unwanted mutations and lower cost, as well as allowing the use of commercially available site-directed mutagenesis kits, and reducing the need for expensive oligonucleotide synthesis. Further, decreasing the number of changes in the NS decreases the potential of altering the secondary structure of the NS, which can have a significant impact on gene expression in certain host cells. The introduction of undesirable restriction sites is also reduced, facilitating the subcloning of sequences into a suitable vector.

In general, any polynucleotide described herein and any general disclosure of a polynucleotide encoding a polypeptide, sequence, or a fragment may be codon optimized for mammals (e.g., humans, other primates, dogs, cats, horses, cows, pigs, or sheep; birds (e.g., ducks, geese, turkeys, or chickens); or any other TR or class of TR(s), e.g., non-HVEM TR(s). In AOTI, compositions and methods of the invention include delivery of a construct containing a sequence that is codon optimized for two or more species. For example, a human codon optimized sequence may be administered to a dog in the scope of the invention both in the preclinical development of a product for human applications and as a method of treatment in dogs.

iii. Sequence Identity and Related Sequences

As DEH, FVs & FFs can be CB the degree their composition (sequence) is identical/related or similar to a reference biomolecule/sequence.

"Relatedness" in such AOTI refers to the amount of identity between sequences that form a FV/FF and a referenced biomolecule. For convenience, several levels of identity are defined in this section.

In a "potentially related" sequence ≥25% of the NTs or AAs of the FV/FF (e.g., at least 20%, 22%, 25%, 27%, or 29% of the nucleotides or residues) are identical to referenced (comparator) sequence(s) in an optimal alignment. Sequences are "likely related" if they exhibit at least about 45% sequence identity in such an alignment. Except for art-recognized homologs, discussed below, "potentially related" sequences typically are not within the scope of FVs generally encompassed by disclosure of a sequence/biomolecule. In general, sequences that exhibit less than about 25% identity can be characterized as "unrelated" to another sequence herein. However, homologs having such low levels of identity can often suitably substitute for each other (as can FFs or FVs of such homologs). For example, the gD homologs of alphaherpesviruses share only 22±33% amino acid identity according to Connolly et al. (Virology 280, 7-18 (2001)). Thus, with respect to gDSs, homologs implicitly disclosed as alternative AOTI can exhibit relatively low levels of identity, provided that such sequences either are art-recognized homologs or suitable FFs/FVs of such homologs.

A sequence that is at least about 70% identical to one or more referenced sequences is "related" to such sequence or sequences. Such sequences are generally considered within the scope of what is implicitly disclosed herein when a passage refers to a particular sequence or biomolecule. A sequence is "very related" to one or more other sequences if it is at least about 80% identical to the referenced sequence or sequences or contains no more than 2 amino acid residue differences from the referenced sequence in sequences of less than about 10 residues. A sequence is "highly related" to a sequence or sequence if it exhibits at least about 90% sequence identity to such reference sequence or sequences or contains no more than 1 amino acid residue differences from the referenced sequence in sequences under 10 amino acid residues. Finally, a sequence is "substantially identical" if it shared at least about 96% identity to a referenced sequence or set of sequences.

References to sequence(s) or related sequences also provides implicit support for AARSs that are SVSHSOCE, or both SVSHSOCE & RVRHROSI to a referenced "related" sequence (e.g., a WTC). The term "similar" in connection with sequence(s) also provides implicit support for sequences that are SVSHSOCE to referenced AARS(s).

In describing FVs WRT WT AARSs/NSs disclosure may refer to AAs/NTs "corresponding" to AAs/NTs in the referenced WT sequence(s). A "corresponding" AA/NT can be located in a different position than the referenced AA/NT, can (if suitable based on context, plausibility, etc.) have a different composition than the referenced AA/NT, or both. E.g., an AA corresponding to WT AARS AA 100 can occur at position 85, 95, 105, or 110 in a FV and can be a different AA, such as a conservative substitution of the AA.

In the art, terms such as "percent homology" and "sequence similarity" are sometimes also used to indicate "identity." In most aspects of this disclosure, however, "similarity" with respect to amino acid residues means the inclusion of compositionally similar amino acid residues, as is discussed below, and "homology" as described above herein relates to two or more sequences or biomolecules identified in the art as being homologs of one another (rather than as a particular degree of similarity).

As KITA, identity in the context of comparing sequences means the amount of sequence components (AAs or NTs) that match when the sequences are optimally aligned. Percent identity of sequences is generally described as the number of exact matches between two aligned sequences divided by the length of the shorter sequence and multiplied by 100. The "best sequence alignment" between two polypeptides is defined as the alignment that produces the largest number of aligned identical residues. Various approaches to aligning sequences and calculating identity based on factors such as permissible gap sizes are known in the art. Such different approaches can result in variation in identity scores. Typically, where sequences are at least highly related such differences are small (e.g., less than 5%, less than 3%, or less than 2%). Such differences are one reason why the term "about" is used to describe identity, as identity can be assessed by a variety of different tests.

A number of programs are KITA for making identity/similarity assessments, including the "Stretcher" and "Needle" alignment tools (which focus on global, pairwise alignments) that are freely publicly available over the internet through EMBL-EBI; the LALIGN program, available through, e.g., ExPASy (which focuses on local alignment of sequences); the UNIRPOT ALIGN tool, & the NCBI COBALT Constraint-based Multiple Alignment Tool. A number of proprietary programs also provide sequence alignment tools (e.g., the DNASTAR Lasergene Molecular Biology Suite (Madison, Wis., USA)). Multiple sequence alignment tools, such as the CLUSTAL line of programs also are well known in the art and are available through, e.g., ExPASy. In aspects, overall identity between 2 sequences is determined using the LALIGN program, BLAST, or both tools (taking an average thereof). Parameters used for AARS analysis using such tools are DEH. Where parameters are not provided or addressed herein the default settings for such tools are assumed to be selected.

Variant sequences can differ from referenced sequences by substitution(s) (changes in NT or AA at position(s)), deletions (where one or more NTs or AAs present in a referenced sequence are missing from the variant in the optimal alignment), or additions (where NTs or AAs are included in a variant but not present in the referenced counterpart). Additions can be characterized by either being insertions within the sequence or additions to either termini of the referenced sequence. Depending on context, each type of variation can be permissible and within the scope of implicitly disclosed variations of a referenced PPT. In aspects, additions ≥insertions in FVs.

Because variants can comprise deletions, the scope of FVs often includes FFs. For example, a disclosure of a 100 AA WT AARS will implicitly include suitable and "related" fragments of the sequence that are between 70 and 99 amino acids in length & larger fragments/extensions of the referenced sequence (if possible) of between 101 and 143 AAs. Thus, a "variant" includes FFs that can exhibit 100% local identity to a referenced sequence. Often such fragments may include an extra Met residue where a start codon has been introduced into the CS, resulting in a HR or SI FV comprising an identical FF.

iv. Methods of Generating Variants

FVs can be generated by any suitable method. Numerous methods have been developed for the generation of suitable, similar, or even improved variants of polynucleotides and polypeptides in the art, which can be employed to generate variants within the scope of the disclosure provided herein.

In one example, variants of a referenced biomolecule or sequence can be made using mutagenesis techniques KITA. Alternatively, variants can be chemically synthesized. In other words, NS FVs can be introduced through mutation techniques, which are KITA, or by design of variant sequences that are generated through recombinant techniques or synthesis. Variations/mutations can be made by or include, e.g., point mutations, deletions and/or insertions. Mutations and other types of variation can introduce changes in biological activity in resulting variants. E.g., a variant/mutant gD chimeric PPT encoded by a construct can have the ability to bind HVEM at a level that is the same as or greater than the ability of a wild type gD protein to bind HVEM. In one example, W294 of HVS-1 gD is replaced with Ala, resulting in enhanced HVEM binding. Other gDS FVs are DEH.

In AOTI, site-specific mutagenesis can be performed on a nucleotide sequence to generate variants of a referenced coding sequence or other functional nucleotide sequence. In one type of such a technique a site for introducing an amino acid may be predetermined, but the mutation per se not be predetermined. Site-specific mutagenesis methods are well known in the art and described in, e.g., Adelman et al., DNA 2:183 (1983) & Ausubel et al. Current Protocols in Molecular Biology, J. Wiley & Sons, NY, N.Y., 1996, and such methods are described further herein and in references cited here.

Other "asexual-like" random, partially random, or directed mutagenesis/evolution methods, such as chemical mutagenesis, are known in the art. Examples of such methods include error prone PCR variant generation/mutagenesis, rolling circle error-prone PCR, targeting glycosylases to embedded arrays for mutagenesis (TaGTEAM), mutagenesis by random insertion and deletion, transposon based random mutagenesis, focused mutagenesis methods, site saturation mutagenesis, sequence saturation mutagenesis (SeSaM), single primer reactions in parallel (SPRINP), mega primed and ligase free focused mutagenesis, Ω-PCR, PFunkel-ominchange-OSCARR, trimer-dimer mutagenesis, and cassette mutagenesis. Cassette mutagenesis is a type of site-directed mutagenesis that uses a short, double-stranded oligonucleotide sequence (gene cassette) to replace a fragment of target DNA. This technique uses complementary restriction enzyme digest ends on the target DNA and gene cassette to achieve specificity. Unlike many other site-directed mutagenesis methods cassette mutagenesis also does not involve primer extension by DNA polymerase. The use of synthetic gene cassette allows total control over the type of mutation that can be generated. When studying protein functions, cassette mutagenesis can allow a scientist to change individual amino acids by introducing different codons or omitting codons. Cassette mutagenesis has been successfully applied to regulatory elements to generate more productive regulatory elements. Such methods are described in, e.g., Worrall, Andrew (1994). Methods in Molecular Biology. 30. Humana Press. pp. 199-210, PMID 8004195 and Wells, J. A.; Vasser, M; Powers, D. B. (1985). Gene. 34 (2-3): 315-23, PMID 3891521.

Thus, mutational methods of generating diversity include, for example, various known site-directed mutagenesis methods (SFE Ling et al. (1997). Anal Biochem. 254(2): 157-178; Dale et al. (1996) Methods Mol. Biol. 57:369-374; Smith (1985) Ann. Rev. Genet. 19:423-462; mutagenesis using uracil containing templates (Kunkel (1985) PNAS 82:488-492 & Kunkel et al. (1987) Methods in Enzymol. 154, 367-382). Other suitable methods for generating variants include oligonucleotide-directed mutagenesis methods (SFE Methods in Enzymol. 100: 468-500 (1983); Methods in Enzymol. 154: 329-350 (1987); & Zoller & Smith (1987) Methods in Enzymol. 154:329-350); phosphorothioate-modified DNA mutagenesis (Taylor et al. (1985) Nucl. Acids Res. 13: 8749-8764; Taylor et al. (1985) Nucl. Acids Res. 13: 8765-8787 (1985); & Sayers et al. (1988) Nucl. Acids Res. 16: 803-814); and mutagenesis using gapped duplex DNA (Kramer & Fritz (1987) Methods in Enzymol. 154: 350-367; Kramer et al. (1988) Nucl. Acids Res. 16: 7207; and Fritz et al. (1988) Nucl. Acids Res. 16: 6987-6999).

Additional suitable diversity-generating methods include point mismatch repair (Kramer et al. (1984) Cell 38:879-887); mutagenesis using repair-deficient host strains (SFE Carter (1987) Methods in Enzymol. 154: 382-403), deletion mutagenesis (Eghtedarzadeh & Henikoff (1986) Nucl. Acids Res. 14: 5115), restriction-selection and restriction-purification (Wells et al. (1986) Phil. Trans. R. Soc. Lond. A 317: 415-423), mutagenesis by total gene synthesis (Nambiar et al. (1984) Science 223: 1299-1301; Sakamar and Khorana (1988) Nucl. Acids Res. 14: 6361-6372; and Grundström et al. (1985) Nucl. Acids Res. 13: 3305-3316); double-strand break repair (Mandecki (1986) PNAS, 83:7177-7181; and Arnold (1993) Current Opinion in Biotechnology 4:450-455). Additional details on many such methods can be found in Methods in Enzymology Volume 154. Other useful mutagenesis techniques include alanine scanning, or random mutagenesis, such as iterated random point mutagenesis induced by error-prone PCR, chemical mutagen exposure, or polynucleotide expression in mutator cells (SFE Bornscheueret et al., Biotechnol. Bioeng., 58, 554-59 (1998), Cadwell and Joyce, PCR Methods Appl., 3(6), S136-40 (1994), Low et al., J. Mol. Biol., 260, 359-68 (1996), Taguchi et al., Appl. Environ. Microbiol., 64(2), 492-95 (1998), & Zhao et al., Nat. Biotech., 16, 258-61 (1998)). Suitable primers for PCR-based site-directed mutagenesis or related techniques can be prepared by the methods described in, e.g., Crea et al., Proc. Natl. Acad. Sci. USA, 75, 5765 (1978).

Other useful techniques for promoting sequence diversity include PCR mutagenesis techniques (as described in, e.g., Kirsch et al., Nucl. Acids Res., 26(7), 1848-50 (1998), Seraphin et al., Nucl. Acids Res., 24(16), 3276-7 (1996), Caldwell et al., PCR Methods Appl., 2(1), 28-33 (1992), Rice et al., Proc. Natl. Acad. Sci. USA. 89(12), 5467-71 (1992) and U.S. Pat. No. 5,512,463), phagemid display techniques (as described in, e.g., Soumillion et al., Appl. Biochem. Biotechnol., 47, 175-89 (1994), O'Neil et al., Curr. Opin. Struct. Biol., 5(4), 443-49 (1995), Dunn, Curr. Opin. Biotechnol., 7(5), 547-53 (1996), and Koivunen et al., J. Nucl. Med., 40(5), 883-88 (1999)), reverse translation evolution (as described in, e.g., U.S. Pat. No. 6,194,550), saturation mutagenesis described in, e.g., U.S. Pat. No. 6,171,820), PCR-based synthesis shuffling (as described in, e.g., U.S. Pat. No. 5,965,408) and recursive ensemble mutagenesis (REM) (as described in, e.g., Arkin and Yourvan, Proc. Natl. Acad. Sci. USA, 89, 7811-15 (1992), and Delgrave et al., Protein Eng., 6(3), 327-331 (1993)). Techniques for introducing diversity into a library of homologous sequences also are provided in U.S. Pat. Nos. 6,159,687 and 6,228,639.

Protein design techniques can be used to develop PPT FVs. Protein design is the rational design of new PPTs to exhibit modified activity, behavior, composition, or purpose. Rational protein design approaches make protein-sequence predictions that will fold to specific structures. These predicted sequences can then be validated experimentally through methods such as peptide synthesis, site-directed mutagenesis, or artificial gene synthesis. Approaches to the development of variants that include rational protein design considerations/methods are often called "protein engineering." Protein engineering includes knowledge-based mutagenesis (KBM), computational protein design (CPD), and directed evolution (DE). Two or all of KBM, CPD, and DE methods can be combined in designing FVs.

KBM applies biochemical principles and knowledge gained from prior studies to guide mutagenesis. E.g., knowledge concerning the regions of HSV-1 gD involved with binding of its receptors has led researchers to develop HSV-1 gD variants and fragments, which has resulted in the identification of gD fragments/variants with modified binding properties, including binding properties that are enhanced with respect to one or more receptors. SFE Rux A H, et al. J. Virology. 1998 September; 72(9):7091-7098 and Connolly S A et al. J Virol. 2005; 79(2):1282-1295.

Directed evolution introduces desired properties into PPTs via random mutation or gene recombination. FVs with desired properties are then identified from these libraries through screening or selection. In its generic form, directed evolution lacks some of the de novo potential of computational design. However, DE can be applied to a protein without detailed knowledge of its structure or the detailed molecular mechanism required for its function. Unlike rational protein engineering, directed evolution provides an a priori approach toward the engineering of improved proteins and regulator elements. This minimally recursive technique builds upon small improvements by selecting and combining the best changes. Protein-protein interactions and other functions can be improved by thousands of times by such methods. Recombination of homologous genes is a powerful mechanism for generating sequence diversity, and homologous recombination techniques can be applied to generate variants, sometimes also employing protein analysis and directed evolution. DNA shuffling is a DE method that includes the creation of novel mutations as well as recombination. In vitro recombination methods such as DNA shuffling are very flexible and can give hybrid genes with multiple crossovers; they have been used extensively to evolve proteins with improved and novel properties. Recently in vivo recombination has been used to generate diversity for directed evolution, e.g., in creating a large phage display antibody library. When DNA shuffling is done between closely related genes (e.g., orthologs) instead of a set of mutant genes derived from a single gene, this technique is usually called DNA family shuffling. DNA family shuffling utilizes the naturally occurring genetic diversity of family genes as the driving force for in vitro evolution. DNA shuffling methods are known in the art and a large variety of such methods exist. Traditional DNA shuffling involves the digestion of a gene by DNaseI into random fragments, and the reassembly of those fragments into a full-length gene by primerless PCR: the fragments prime on each other based on sequence homology, and recombination occurs when fragments from one copy of a gene anneal to fragments from another copy, causing a template switch, or crossover event. Alternative methods use restriction enzymes that cut in similar places are used to digest members of the gene family and such DNA fragments are joined together with DNA ligase.

Such methods are often effective in generating suitable variants. In a noteworthy, early example of DNA shuffling, a family of 20 human interferon-alpha genes was shuffled followed by selection of antiviral and antiproliferation activities in murine cells, resulting in variants having 285,000-fold increased activity. The best chimeras generated by such methods were composed of up to five parental genes and contained no random point mutations. In another example, shuffling of 26 homologous protease genes generated many chimeric proteases that were significantly improved over any of the parental enzymes.

A variety of approaches to directed evolution methods, such as DNA shuffling are now known in the art and include random priming In vitro recombination (RPR), truncated metagenomic gene-specific PCR, staggered extension process (StEP) methods, random chimeragenesis on transient templates (RACHITT), mutagenic organized recombination process by homologous in vivo grouping (MORPHING), phage-assisted continuous evolution (PACE), exon shuffling, incremental truncation for the creation of hybrid enzymes (ITCHY), SCRATCHY methods, recombined extension on truncated templates (RETT), sequence homology-independent protein recombination (SHIPREC), sequence independent site directed chimeragenesis (SISDC), degenerate homo-duplex recombination (DHR), random multi-recombinant PCR (RM-PCR), user friendly DNA recombination (USERec) methods, Golden Gate shuffling (GGS) recombination, phosphoro thioate-based DNA recombination method (PRTec), Y-Ligation based shuffling (YLBS) methods, and methods involving mutagenesis PCR with dITP and fragmentation by endonuclease V, amongst others. Examples of such methods and other methods and related principles are described in, e.g., Stemmer in 1994 (Stemmer, Proc Natl Acad Sci USA 91, 10747-10751, 1994; Stemmer, Nature 370, 389-391, 1994); Werkman J R, Pattanaik S, Yuan L. Directed evolution through DNA shuffling for the improvement and understanding of genes and promoters. Methods Mol Biol. 2011; 754:325-342; Kolkman J A, Stemmer W P. Directed evolution of proteins by exon shuffling. Nat Biotechnol. 2001; 19(5):423-428; Whalen R G, Kaiwar R, Soong N W, Punnonen J. DNA shuffling and vaccines. Curr Opin Mol Ther. 2001; 3(1):31-36; Locher C P, Soong N W, Whalen R G, Punnonen J. Development of novel vaccines using DNA shuffling and screening strategies. Curr Opin Mol Ther. 2004; 6(1):34-39; and Feng H, Wang H Y, Zhao H Y. Novel Random Mutagenesis Method for Directed Evolution. Methods Mol Biol. 2017; 1498:483-490. Various directed evolution and other diversity generating methods are described in, e.g., U.S. Pat. Nos. 7,771,974; 5,605,793; 5,811,238; 5,830,721; 5,834,252; 5,837,458; WO 95/22625; WO 96/33207; WO 97/20078; WO 97/35966; WO 99/41402; WO 99/41383; WO 99/41369; WO 99/41368; EP 752008; EP 0932670; WO 99/23107; WO 99/21979; WO 98/31837; WO 98/27230; WO 98/27230; WO 00/00632; WO 00/09679; WO 98/42832; WO 99/29902; WO 98/41653; WO 98/41622; WO 98/42727; WO 00/18906; WO 00/04190; WO 00/42561; WO 00/42559; and WO 00/42560.

Another aspect of protein engineering that also or alternatively can be used to develop suitable variants is computation protein design. Computational protein design (CPD) uses molecular modeling programs to predict amino acid sequences that will fold into a desired structure. CPD can comprise generating protein design candidates by mutating residues on an existing high-resolution structure and then energetically evaluating the designs to find variants that are optimized for certain physicochemical properties such as protein stability or enzymatic activity. PPTs can be computationally designed from the level of AARS(s)/AA(s) to the level of a functional protein complex. Design targets range from increased thermo- (or other) stability to specific requested reactions such as protein-protein binding, enzymatic reactions, or nanotechnology applications. The design scheme may encompass small regions of the proteins or the entire protein. In either case, the design may aim at the side-chains or at the full backbone conformation. There have been several recent successful examples of successful rational design of water-soluble and even transmembrane peptides and proteins, in part due to a better understanding of different factors contributing to protein structure stability and development of better computational methods. A second very important engineering target is enzyme thermostability. Homology modeling & rational evaluation of PPT structure has been useful in identifying stabilized FVs Descriptions of a variety of diversity generating procedures for generating modified nucleic acid sequences that encode variant polypeptides of the invention or other variant nucleotide sequences of those specific sequences described herein are found in the following publications and the references cited therein: Soong, N. et al. (2000) Nat Genet 25(4):436-439; Stemmer, et al. (1999) Tumor Targeting 4:1-4; Minshull and Stemmer (1999) Current Opinion in Chemical Biology 3:284-290; Patten et al. (1997) Current Opinion in Biotechnology 8:724-733; Stemmer (1996) "Sexual PCR and Assembly PCR" In: The Encyclopedia of Molecular Biology, VCH Publishers, New York. pp. 447-

457; Stemmer (1995) "The Evolution of Molecular Computation" Science 270: 1510; Nature 491 (7423): 204-5; Samish I. (2017) Methods Mol Biol. 1529:3-19; Chica R A (2015) Protein Sci. 24(4):431-433; Tobin P H et al. (2014) Curr Drug Metab. 15(7):743-756; Lutz S, Iamurri S M. (2018) Methods Mol Biol. 1685:1-12; Wang P L (2000) Dis Markers 16(1-2):3-13; Samish I. Methods Mol Biol. 2017; 1529:21-94; & Giver L, et al. Curr Opin Chem Biol. 1998; 2(3):335-338.

Any suitable combination of deletion, insertion, & substitution modifications can be used to arrive at a FV, provided the variant retains at least one intended/required activity at a suitable, comparable, or improved level.

As noted above, amino acid sequence insertions include amino and/or carboxyl-terminal fusions of from 1+ AAs to PPTs of essentially unrestricted length, as well as intrasequence insertions of 1, 2, or 2+ AARs. Intrasequence insertions (i.e., insertions within the sequence of a wild-type polypeptide or sequence) can range generally from, e.g., about 1 to 15 residues, about 1-10 AAs, 1-7 AAs, 1-5 AAs, or 1 to 3 residues (e.g., per every about 200 residues, every 150 residues, every 125 residues, or every 100 residues). Variation by intrasequence deletions or by a combination of deletions & insertions typically is limited to a similar proportion of variation. Variation by intrasequence substitutions may be possible with a higher level of change (e.g., about 1-25 residues, about 1-20 residues, about 1-15 residues, about 1-10 residues, or about 1-5 residues), particularly where substitutions primarily comprise, GCO, or CO conservative substitutions (DFEH).

POOSITA will understand principles applicable to generation of FVs. For example, cysteine and methionine residues are KITA to be susceptible to rapid oxidation in some peptides and multiple cysteines located in a peptide are susceptible to forming structure-changing disulfide linkages. N-terminal glutamine residues can be unstable, because such a residue can form cyclic pyroglutamate under acidic conditions. Aspartic acid can undergo hydrolysis and cause peptide cleavage under acidic conditions when paired with glycine, proline or serine. Multiple serine or proline residues in a sequence can cause significant deletions during synthesis, especially proline residues, which can undergo cis/trans isomerization and reduce peptide purity. A series of glutamine, isoleucine, leucine, phenylalanine, threonine, tyrosine or valine can cause p sheets. From the foregoing it will be understood that substantial changes in function can be made by selecting substitutions that are less conservative than those shown in the defined groups, above. For example, non-conservative substitutions can be made which more significantly affect the structure of the peptide in the area of the alteration, for example, the alpha-helical, or beta-sheet structure; the charge or hydrophobicity of the molecule at the target site; or the bulk of the side chain.

Substitutions expected to produce significant changes in a PPTs properties include those where 1) a hydrophilic residue, e.g., seryl or threonyl, is substituted for (or by) a hydrophobic residue, e.g., leucyl, isoleucyl, phenylalanyl, valyl, or alanyl; 2) a Cys or Pro is substituted for (or by) any other residue; 3) an AA having an electropositive side chain, e.g., lysyl, arginyl, or histidyl, is substituted for (or by) an electronegative AA, e.g., glutamyl or aspartyl; or 4) an AA having a bulky side chain, e.g., phenylalanine, is substituted for (or by) an AA that does not have a side chain, e.g., Gly.

These and other nonconservative substitutions can be introduced into peptide variants where significant changes in function/structure is desired and avoided where conservation of structure/function is desired. Accordingly, in some aspects, variants having some or all of the above-described features can be excluded from the scope of suitable variants.

v. Homologs

As noted above, "homologs" are another group of molecules and sequences that can often be expected to suitably, substantially similarly, or improvingly substitute for a referenced biomolecule or sequence in AOTI. Accordingly, homologs are generally considered implicitly disclosed by disclosure of a referenced polypeptide, amino acid sequence, or nucleotide sequence herein, unless the disclosure clearly indicates otherwise.

Homologs are polypeptides, polynucleotides, and respective sequences of each, which occur in natural organisms (e.g., vertebrates, viruses, bacteria, etc.). A homolog of a reference polypeptide can naturally occur in the same species or different species/type of organism than the species/type in which the reference sequence is naturally produced.

A homolog of a biomolecule can be any suitable biomolecule that is currently identified as a homolog of the referenced biomolecule or that will similarly be identified as a homolog in the future based on the structural and functional analysis that has led to the identification of currently known homologs. A homolog of a sequence that is a functional fragment of a biomolecule is a corresponding sequence from a homolog to a reference sequence, such as a corresponding domain, e.g., the transmembrane domain of a gD polypeptide, the nectin-1 binding domain of gD homologs, and the like.

Examples of well-known homologs include human growth hormone (hGH) and bovine growth hormone (bGH); insulin-like growth factors (IGFs), bone morphogenic proteins (BMPs), and insulins, but also include polypeptides that characterize aspects of this invention such as gD polypeptides (e.g., HSV-1 gD and HSV-2 gD are homologs), HVEM, and EAT-2 polypeptides (e.g., murine EAT-2 and human EAT-2), to name a few examples. In the context of this disclosure, a suitable homolog to a referenced biomolecule/sequence typically will exhibit a suitably similar structure and at least some common functionality.

It is important to note that a "homolog" in the context of this disclosure does not necessarily mean that the homologous sequences share true "homology," in terms of evolutionary origin, particularly since the demonstration of such homology is extremely difficult, if not impossible, in most cases. A "homolog" herein can include, e.g., orthologs, paralogs, an allelic variant, and other "cognates" or counterparts of a referenced biomolecule or sequence found in other organisms of a species or other species from which a referenced molecule or sequence originates.

Like suitable variants, a suitable homolog included within the implicit or explicit scope of disclosure of an aspect of the invention herein that refers to a particular reference biomolecule or reference sequence will, unless otherwise indicated, include one or more common functions with a referenced sequence at a suitable, comparable, or improved level of ≥1 function(s). As such, some paralogs of biomolecules would not be considered "homologs" in this disclosure (e.g., where such paralogs lack any common function).

In addition to arising from genetic relatedness, exemplified above, homologs can arise from alternate mRNA splicing events or from alternative proteolytic cleavage of a naturally occurring/endogenous polypeptide. Alternate splicing of mRNA may, for example, yield a truncated but biologically active protein, such as a naturally occurring soluble form of the protein.

Variations attributable to proteolysis that may result in homologs in or between species include, for example, differences in the N- or C-termini upon expression in different types of host cells, due to proteolytic removal of one or more terminal amino acids from the protein (e.g., from 1-5 terminal amino acids). PPTs in which differences in amino acid sequence are attributable to genetic polymorphism (allelic variation among individuals producing the protein) also can account for homologs within a species or population.

Some homologs that are sufficiently related to a sequence or biomolecule may fall within the scope of what is a suitable variant. In such cases, homologs within the scope of the definition of a variant can be both classified as both homologs and variants of a sequence or biomolecule. In other words, these terms do not have to be exclusive.

Similar structure and function of polypeptides is typically used to determine homology in the art. It should be, once again, noted that while there is a strong correlation between a determination of homology and sequence identity, homologs can, in some cases, exhibit relatively low levels of identity, and still be classified in the art as being homologs. For example, although sequences of the ribosomal protein L36 in different species exhibit considerable diversity in sequence, and only a single amino acid residue is conserved in all such sequences, they still have structures that clearly align, have similar functions, and, thus, are considered to be well-established homologs. As such, there is no minimum sequence identity or similarity requirement for defining a "homolog," and the best defining characteristic is recognition in the art of homology based on overall similar of structure, even if identity is relatively low, and some overlap in function (though, as noted below, the function of recognized homologs can differ in part).

Like FVs, homolog substitutes for referenced NSs are not limited to CSs, but can include regulatory sequences, e.g., promoters or EEIs.

In AOTI, constructs having features described herein are replaced with a homolog of a referenced sequence(s). E.g., HSV-1 gD sequences described herein can be replaced with a corresponding gD sequence from HSV-2 gD, a variant of an HSV-1 gD sequence, or a gD sequence from a type of alphavirus that typically infects other hosts, such as a chicken (Gallus HV gD), a horse (e.g., EHV-1 gD), a cow (e.g., BHV-1 gD or BHV-5 gD), or a pig (e.g., PRV gD). E.g., described HSV-1 gD constructs that comprise a soluble form of gD lacking a TMD can be replaced with a corresponding soluble portion of a mature HSV-1 gD homolog (e.g., a soluble PRV gD or EHV-1 gD, such as in an aspect where a construct encoding AAs 26-340 of HSV-1 gD (SEQ ID NO:82) is replaced with the homologous sequence consisting essentially of AAs 31-357 of Gallid Alphaherpesvirus-2 (GenBank Accession No. AAA64967.1)).

In aspects, one or more sequences encoded by constructs are homologs of corresponding sequences endogenous to the intended host/subject species or to a virus that infects the intended host/species. For example, In AOTI, methods comprise use of constructs that encode one or more HSV-1 gD sequences which are administered to dogs, pigs, or cats, as opposed to the gD sequences of viruses that normally infect such species.

a. Chimeras

Although the term "chimera" is sometimes used in the art to refer to any fusion protein, in TD terms such as "chimera" or "chimeric sequence" are used to refer to molecules and sequences, respectively, that are fusion proteins that comprise 2 or more sequences MCRT different WT sequences that are homologs of one another. Such sequences/molecules also are sometimes referred to as "hybrids" or "hybrid sequences."

In AOTI, the invention provides constructs encoding gD PPTs that comprise chimeric sequence(s), e.g., formed from a HSV-1 gD sequence and an HSV-2 gD sequence (e.g., the HVEM binding domain of the HSV-1 gD sequence is replaced with corresponding residues from HSV-2 gD or the HVEM-binding domain of HSV-1 gD or a substantially identical or highly related variant is fused with sequences corresponding to most, generally all, substantially all, or all of the portion of HSV-2 gD that are located downstream of the portion of HSV-2 gD that corresponds to the HVEM-binding domain of the fusion protein). An example of such a chimera is a gDP comprising AAs ~26 to 55 of HSV-1 gD and AAs ~56-393 of HSV-2 gD or residues ~56-340 of HSV-2 gD. Fusion proteins comprising sequences from, substantially identical to, or at least highly related to any two or more (e.g., 3, 4, or 5) of the naturally occurring gD polypeptides discussed herein or other homologs thereof can be included in such chimeric fusion proteins. Thus, for example, gD chimeras can be formed from the fusion of gD sequences from chicken and turkey alphaherpesviruses; dog and cat alphaherpesviruses; human and horse alphaherpesviruses; human, dog, and cat alphaherpesviruses; and the like.

vi. Additional Characteristics of Variants, Homologs, and Fragments

In aspects, FVs are CB similarity in AARS composition, similar structure, or both. In aspects, FVs comprise sequences related in identity and similar in composition to a WTC (and AOA have a confirmed similar structure).

a. Compositional Similarity & Conservative Substitutions

FVs can comprise conservative or non-conservative AA substitutions, deletions, or additions, or CT with respect to referenced sequence(s) (e.g., a WT EL PPT, such as an EAT-2 PPT). Typically, most, generally all, or substantially all of such substitutions will be conservative substitutions. Typically, the amount of deletions or "gaps" between AAs in FVs WRT to WTCs will be limited (e.g., to ≤5%, ≤3%, or under 2% of total AAs).

Substitutions with similar AAs (conservative substitutions) often can lead to comparably functional FVs. In cases where most of the differences between a variant polypeptide or sequence and a referenced polypeptide or amino acid sequence are defined by conservative amino acid substitutions, the variant can be considered to have a "similar" sequence or composition. Thus, for example, even though one or more variants may have a percent identity that would only indicate it is "potentially related" to the one or more reference sequences or polypeptides in question, it or they may be sufficiently similar to a referenced sequence or biomolecule to exhibit a similar, if not enhanced, function as compared to the referenced biomolecule or sequence.

Like identity, "similarity" can be determined by amino acid comparison of two or more polypeptides or sequences in an optimal alignment, which can be based on either the best identity alignment, as provided by the various above-described alignment tools or similar tools in the art, or by other tools used for making assessments in the art, where "similar" amino acid residues are either identical or determined by one or more standards to possess similar chemical and/or physical properties that are relevant to the structure and functioning of the amino acid sequence, such as charge or hydrophobicity. There are a number of standards in the art for grouping substitutions to determine what is a conservative substitution. Examples of such grouping and related principles are described in, e.g., US20160151478. Such groupings can help those of skill in the art to design or characterize similar variants.

A "percent similarity" can be determined between 2+ compared PPTs/AARSs using such tools or manual calculation using principles KITA or DEH. As with assessing sequence identity, approaches can lead to variation in the amount of identity, but, highly similar sequences will tend to have similar similarity scores, regardless of the approach taken to assess similarity. Because of such variations, use of the approximator "about" in connection with most measures of similarity values is appropriate.

It can be useful to define certain aspects based on levels of "similarity" between AARSs. In this disclosure a "similar" amino acid sequence exhibits at least about 75% amino acid similarity to a reference sequence in an optimal alignment. A "very similar" amino acid sequence is composed of at least about 85% similar amino acid residues to one or more reference amino acid sequences. A "highly similar" sequence is composed of at least about 92% similar residues to one or more reference amino acid sequences. A "substantially compositionally equivalent" (SCE) is composed of at least about 98% amino acid residues that are similar (conserved) WRT to a referenced AARS.

Alignment tools such as those described above for determining identity also often have the capability of determining similarity between sequences. For example, the LALIGN program will compare two sequences on the basis of both residue identity and similarity in an optimal alignment. The BLAST 2 sequences tool will produce alignments with identity and "positives" scores, which can be used in place of similarity scores generated by LALIGN or an average of the two can be used where analysis with either tool is suitable. These tools can also be substituted with similar analytical tools available ITA.

A scoring matrix used to assess similarity can impact the similarity score between two sequences obtained through such tools. As such the settings in the following Table 1 are used to assess identity or similarity with amino acid sequences of different lengths—

| Sequence Length (AAs) | Substitution Matrix | Gap Penalty | Extension penalty |
|---|---|---|---|
| <35 | PAM-30 | 9 | 1 |
| 35-50 | PAM-70 | 10 | 1 |
| 50-85 | BLOSUM-80 | 10 | 1 |
| 85 | BLOSUM-62 | 10 | 1 |

Alternative methods for analyzing shorter amino acid sequences that may be suitable used in place of this method are described in, e.g., Pearson W R. Selecting the Right Similarity-Scoring Matrix. Curr Protoc Bioinformatics. 2013; 43:3.5.1-3.5.9.

The disclosure of any referenced sequence or polypeptide also implicitly provides support for variants that are at least related (in terms of identity), or at least at least similar (or very similar (VS), highly similar (HS), or compositionally equivalent (OCE) (VSHSOCE)) to the referenced sequence or polypeptide. Thus, for example, a reference to a particular EAT-2 polypeptide in a method or composition will, unless clearly contradicted, be understood to also implicitly provide corresponding disclosure of the use of EAT-2 variants thereto that are SVSHSOCE thereto used in place of the referenced EAT-2 polypeptide. For example, the reference to human EAT-2 in an aspect would implicitly provide support for the use of human EAT-2 variants that comprise a similar sequence to EAT-2, which would include, for example, its murine homolog (which exhibits 88.6% similarity according to LALIGN and 81% positives according to BLAST (analyzed by BLAST 2 SEQUENCES)).

In some cases, such similar variants may also exhibit a high enough level of identity to a referenced polypeptide or sequence to be considered related in terms of sequence identity, as well as similar in terms of sequence similarity. Thus, for example, such polypeptide and sequences that are implicitly disclosed should be considered to include polypeptides and sequences that are at least related in identity to the referenced sequence or polypeptide and also similar, very similar, highly similar, or substantially compositionally equivalent to the referenced biomolecule or sequence. For example, full length HSV-2 gD may implicitly substitute full length HSV-1 gD as it exhibits about 82% sequence identity and about 93% similarity according to LALIGN analysis using the above-described settings and 78% identity and 84% positives according to BLAST using the same settings. Thus, even under the more stringent of these two tests these homologs would both be considered "related" in terms of identity and at least "similar" (highly similar according to LALIGN and very similar if taking an average of LALIGN and BLAST data).

Other statistical tools in the art also or alternatively can be used to characterize similarity between two or more sequences. Examples of such tools are bit scores and E-values, which are, for example, reported as outputs of analysis by BLAST tools. The Expect value (E or E-value) is a parameter that describes the number of hits one can "expect" to see by chance when searching a database of a particular size. The lower the E-value, the less likely that a match is a result of random chance and therefore the more significant a match. A sequence alignment that has an E-value of 0.05 means that the detected level of similarity between the sequences has a 5 in 100 (1 in 20) chance of occurring by chance alone. An E-value >10e-100 usually also or alternatively indicates the compared sequences are identical, substantially identical, or substantially compositionally equivalent. At 10e-50<E-value<10e-100, the sequences also or alternatively can be considered highly similar. At 10e-10<E-value<10e-50, the sequences also or alternatively can be considered to be very similar. At 10e-6<E-value<10e-10 the sequences also or alternatively can be considered similar sequences. For example, murine and human EAT-2 exhibit an E-value of 1 e-62 when compared by BLAST (using BLAST 2 Sequences), indicating that on this criteria these polypeptides are "highly similar." Skilled artisans recognize that E-values are very dependent on the query sequence length and the database size. Short identical sequence may have a high E-value and may be regarded as "false positive" hits. As such, the use of E-values may be limited to sequences of more than 40 amino acid residues, more than 50 amino acid residues, more than 60 amino acid residues, or more than 100 amino acid residues. E-value measurements are also provided in other types of sequence comparisons, such as comparisons of sequences with domains in domain databases, as DEH.

The bit score, which is another output of BLAST analysis tools and other bioinformatics sequence analysis software programs, gives an indication of how good an alignment is between two sequences. The higher the score, the better the alignment. In general terms, this score is calculated from a formula that takes into account the alignment of similar or identical residues, as well as any gaps introduced to align the sequences. Thus, the bit score is dependent on the "substitution matrix" used in the analysis of the sequences (e.g., BLOSUM62, BLOSUM50, PAM70, or PAM30). A bit score of 175 or higher also or alternatively can indicate that two sequences are highly similar (e.g., an alignment of golden monkey and human EAT-2 sequences has a bit score of 248 with 99% identity), a bit score of 125-175 also or alternatively can indicate two sequences are at least very similar (e.g., an alignment of murine EAT-2 and human EAT-2 is associated with a BLAST bit score of 173 at 65% identity and 81% positives), and a bit score of 75-125 can at least indicate that two sequences are similar.

Other conservative substitutions, e.g., involving substitutions of entire regions having similar hydrophobicity characteristics, are well known, and can be considered within the broader context of determining amino acid sequence similarity. Thus, changes that can be considered "conservative" can further be classified, in part, by considering the hydropathic index of amino acids, as understood in the art. Kyte et al., J. Mol. Biol. 157:105-132 (1982). The hydropathic index of an amino acid is based on a consideration of its hydrophobicity and charge. It is KITA that AAs of similar hydropathic indexes can be substituted and still retain protein function. In AOTI, AAs having hydropathic indexes of ±2 counterpart AAs are substituted for counterpart AAs. The hydrophilicity of amino acids can also be used to reveal substitutions that would result in proteins retaining biological function. A consideration of the hydrophilicity of amino acids in the context of a peptide permits calculation of the greatest local average hydrophilicity of that peptide, a useful measure that has been reported to correlate well with antigenicity and immunogenicity. Substitution of amino acids having similar hydrophilicity values can result in peptides retaining biological activity, for example immunogenicity, as is understood ITA. Substitutions can be performed with amino acids having hydrophilicity values within ±2 of each other. Both the hydrophobicity index and the hydrophilicity value of amino acids are influenced by the particular side chain of that amino acid. Consistent with that observation, amino acid substitutions that are compatible with biological function are understood to depend on the relative similarity of the amino acids, and particularly, the side chains of those amino acids, as revealed by the hydrophobicity, hydrophilicity, charge, size, and other properties. Related principles for some polypeptides that may comprise surface-exposed and non-exposed, interior residues are known in the art (SFE Moelbert S, Emberly E, Tang C. Correlation between sequence hydrophobicity and surface-exposure pattern of database proteins. Protein Sci. 2004; 13(3):752-762. doi: 10.1110/ps.03431704). Tools for such analysis are also available in the art. For example the ProtScale tool allows users to analyze a sequence on the basis of hydrophobicity (several different ways), bulkiness, and polarity, and to also perform several structural analyses.

In AOTI, conservation in terms of hydropathic/hydrophilic properties also is substantially retained in a variant polypeptide or sequence as compared to a referenced (parent) peptide of sequence (e.g., the weight class, hydropathic score, or both of the sequences are at least about 50%, at least about 60%, at least about 70%, at least about 75%, at least about 80%, at least about 85%, at least about 90%, at least about 95%, or more (e.g., about 65-99%) retained). Methods for assessing the conservation of the hydropathic character of residues/sequences are known in the art and incorporated in available software packages, such as the GRAVY program (available at gravy-calculator.de/) and the GREASE program (formerly available through the SDSC Biology Workbench) (see also, e.g., Kyte and Doolittle et al., J. Mol. Biol. 157:105-132(1982); Pearson and Lipman, PNAS (1988) 85:2444-2448, and Pearson (1990) Methods in Enzymology 183:63-98 for a discussion of the principles incorporated in GRAVY, GREASE, and similar programs).

1) Hybridization of Similar Polynucleotides

Compositional similarity in NSs can AOA be assessed through NAM hybridization techniques KITA. In NAM hybridization, a nucleic acid probe typically is chosen that is complementary to a target NS, and then by selection of appropriate conditions the probe and the target sequence "selectively hybridize," or bind, to each other to form a hybrid molecule. A NA capable of hybridizing selectively to a target sequence under "moderately stringent" typically hybridizes under conditions that allow detection of a target nucleic acid sequence of ≥~10-14 nucleotides in length having at least approximately 70% sequence identity with the sequence of the selected nucleic acid probe. Stringent hybridization conditions typically allow detection of target NSs of at least about 10-14 nucleotides in length having a sequence identity of greater than about 90-95% with the sequence of the selected nucleic acid probe.

Hybridization conditions useful for probe/target hybridization where the probe and target have a specific degree of sequence identity, can be determined as is known in the art (see, for example, Nucleic Acid Hybridization: A Practical Approach, BD Hames and SJ Higgins, Eds. (1985) Oxford; Washington, D.C.; IRL Press). Hybridizing nucleotide sequences can be useful, for example, with respect to naturally occurring homologs of a particular reference sequence that can be considered implicitly provided by and within the scope of a disclosed sequence, such as a non-coding sequence (e.g., an expression-enhancing intron, a promoter, or an enhancer). Nucleic acid hybridization methods are KITA (SFE Sambrook et al., 2001, Molecular Cloning, A Laboratory Manual, Cold Spring Harbor Press, N.Y.; and Ausubel et al., 1989, Current Protocols in Molecular Biology, Green Publishing Associates and Wiley Interscience, N.Y). POOSITA will be able to set appropriate stringency conditions to assess whether sequences meet a threshold level for hybridization that is indicative of an at least minimum level of similarity.

For example, hybridization may be carried out under moderate to stringent conditions, to the complement of a DNA encoding a native caspase peptide. Moderate hybridization conditions are exemplified by overnight incubation at 42° C. in a solution comprising: 10-20% formamide, 5×SSC (150 mM NaCl, 15 mM trisodium citrate), 50 mM sodium phosphate (pH 7.6), 5×Denhardt's solution, 10% dextran sulfate, and 20 ng/ml denatured, sheared salmon sperm DNA. In AOTI, a reference to a nucleotide sequence herein will be understood as implicitly providing disclosure of related sequences that would hybridize to the sequence under at least moderately stringent conditions.

In AOTI, a reference to a nucleotide sequence herein will be understood to implicitly encompass nucleotide sequences that hybridizes to the defined sequence under stringent hybridization conditions. Stringent hybridization conditions can be exemplified by 0.015M sodium chloride, 0.0015M sodium citrate at about 65-68° C. or 0.015M sodium chloride, 0.0015M sodium citrate, and 50% formamide at about 42° C.

b. Structural Similarity of Domains and Polypeptides

In AOTI, variants of a referenced polypeptide or amino acid sequence can further be characterized on the basis of having a similar predicted/confirmed structure, in part or all of a biomolecule.

Aspects that are directed/limited to amino acid sequence or polypeptide variants that are structurally as well as compositionally similar (in terms of sequence identity, sequence similarity, or both), typically will have a higher rate of variants that function similarly, equivalently, or better than the reference sequence or polypeptide. As such, the implicit disclosure of amino acid sequences and polypeptides herein includes, In AOTI, variant sequences and polypeptides that also exhibit any one or more of such levels of structural similarity to the reference polypeptide or amino acid sequence. For example, the disclosure of an aspect of this invention relating to a HSV-1 gD sequence will be understood to implicitly disclose use of variants of such sequence that are related or similar in sequence composition and also structurally similar in one or more aspects across one or more parts of HSV-1 gD.

While variants will typically comprise a similar structure to a referenced sequence and homologs will likewise often share a similar structure, this may be in only part of a sequence or molecule. For instance, the plant Flu regulatory protein is present both in *Arabidopsis* (multicellular higher plant) and *Chlamydomonas* (single cell green algae), but the *Chlamydomonas* version (homolog) is more complex, crossing the membrane twice rather than once, containing additional domains, and undergoing alternative splicing, while still retaining the ability to fully substitute the much simpler *Arabidopsis* protein homolog if transferred by genetic engineering.

Structural determinations of polypeptides and amino acid sequences can be made by any suitable technique, including by empirical analysis, computer modeling based on sequence information, or both.

1) Experimental Methods for Analyzing Structure

Several empirical methods for determining protein structure are KITA and the results of such analyses can be used to evaluate the structural similarity of variants. Experimental methods for assessing structural similarity of polypeptides that can be applied to determine structural similarity of variants include nuclear magnetic resonance (NMR) techniques (including two dimensional and three dimensional NMR methods), microscopy techniques such as cryo-electron microscopy, Raman spectroscopy small angle x-ray scattering techniques, circular dichroism methods; Fourier Transform Infrared (FTIR) spectroscopy; or X-ray crystallography (e.g., scattering or diffraction methods).

Nuclear magnetic resonance (NMR) spectroscopic structure determination techniques are well-known in the art (SFE Wuthrich, NMR of Proteins and Nucleic Acids, Wiley, New York, 1986; Wuthrich, K. Science 243:45-50 (1989); Clore et al., Crit. Rev. Bioch. Molec. Biol. 24:479-564 (1989); Cooke et al. Bioassays 8:52-56 (1988)). In AOTI, the determination of similarity comprises a positive result in a two-dimensional NMR analysis. Additional principles and methods relating to the use of NMR for determination of protein structure, which can be employed to determine structural similarity of variants, are descried in, e.g., T. Kevin Hitchens et al. (2005). Fundamentals of Protein NMR Spectroscopy (Focus on Structural Biology). Berlin: Springer. ISBN 978-1-4020-3499-2; Quincy Teng (2005). Structural Biology: Practical NMR Applications. Berlin: Springer. Bibcode:2005stbi.book.T. ISBN 978-0-387-24367-2; Mark Rance et al. (2007). Protein NMR Spectroscopy: Principles and Practice (2nd ed.). Boston: Academic Press. ISBN 978-0-12-164491-8; Kurt Wüthrich (1986). NMR of Proteins and Nucleic Acids. New York: Wiley. ISBN 978-0-471-82893-8; Bax A. Annu Rev Biochem. 1989; 58:223-256; Wüthrich K. Acta Crystallogr D Biol Crystallogr. 1995; 51(Pt 3):249-270; Oschkinat, H et al. Nature 332, 374-376 (1988); Clore et al., Annu. Rev. Biophys. Biophys. Chern. 1991.20:29-63; Sugiki T et al. Comput Struct Biotechnol J. 2017; 15:328-339; and Howard, M Current Biology, Volume 8, Issue 10, PR331-R333, May 7, 1998. Methods for the preparation and labeling of proteins for NMR with 13C, 15N, and 2H for structural determinations are described in U.S. Pat. No. 6,376,253. NMR spectroscopy of large or complex proteins is described in U.S. Pat. No. 6,198,281. Use of nuclear magnetic resonance to design ligands to target biomolecules is described in U.S. Pat. No. 5,989,827. In AOTI, structural similarity of a FV is confirmed by comparison of NMR data.

X-ray crystallography methods are also KITA. SFE Shi Y. Cell. 2014; 159(5):995-1014 and Ilari A, Savino C. Methods Mol Biol. 2008; 452:63-87. For a description of the crystallization conditions, methods for obtaining and interpreting the resultant crystal structures, and discussions on the biologically active regions of these proteins based on structural models, see, Griffith et al., Proc Natl Acad Sci USA. 1996 Jan. 23; 93(2):878-83 & Scheufler et al., J Mol Biol. 1999 Mar. 19; 287(1):103-15. In AOTI, structural similarity is determined by a method comprising the use of X-ray crystallography data. In AOTI, similarity is determined by serial femtosecond crystallography. In AOTI, structural similarity is determined by free electron X-ray laser (XFEL). Crystallization methods and analysis of crystalized molecules are described in at least U.S. Pat. Nos. 6,329,184 & 6,403,330. Methods for using x-ray topography and diffractometry to improve protein crystal growth are described in U.S. Pat. No. 6,468,346. Methods and apparatus for automatically selecting Bragg reflections, and systems for automatically determining crystallographic orientation are described by U.S. Pat. No. 6,198,796.

In AOTI, both NMR and crystallography methods are used to generate data of a reference polypeptide or sequence and a variant polypeptide or sequence to determine similarity. The combined use of NMR and X-Ray crystallography methods are known in the art. SFE Yee A A, Savchenko A, Ignachenko A, et al. NMR and X-ray crystallography, complementary tools in structural proteomics of small proteins. J Am Chem Soc. 2005; 127(47):16512-16517; Szymczyna B R, Taurog R E, Young M J, Snyder J C, Johnson J E, Williamson J R. Synergy of NMR, computation, and X-ray crystallography for structural biology. Structure. 2009; 17(4):499-507; and Berg J M, Tymoczko J L, Stryer L. Biochemistry. 5th edition. New York: W H Freeman; 2002. Section 4.5, Available from:.

In aspects, structural similarity is established through a method that comprises electron microscopy analysis of compared biomolecules or sequences. Three dimensional electron microscopy, frequently referred to as 3DEM, can also be used to determine 3D structures of large macromolecular assemblies including PPTs. Commonly used methods involve imaging of many thousands of different single particles preserved in a thin layer of non-crystalline ice (cryo-EM). Cryo-EM methods for polypeptide analysis are described in, e.g., Fernandez-Leiro R, et al. Nature. 2016; 537(7620):339-346. Combined use of cryo-EM & X-ray crystallography is described in, e.g., Venien-Bryan C et al. Acta Crystallogr F Struct Biol Commun. 2017; 73(Pt 4):174-183 & Wang H W, Wang J W. Protein Sci. 2017; 26(1):32-39.

In aspects, the structural analysis of a referenced polypeptide or sequence, a variant polypeptide or sequence, or both, comprise the use of mass spectrometry data. Mass spectrometry ("MS") methods have been successfully employed to determine protein structure. SFE Vandermarliere E, et al. Mass Spectrom Rev. 2016; 35(6):653-665. In AOTI, such a method comprises the use of chemical cross-linking mass spectrometry (CXMS), which can provide a low-resolution analysis that can be employed with small amounts of sample material as compared to NMR or X-Ray crystallography. The use of CXMS is described in, e.g., Sinz, A. (2003) Journal of Mass Spectrometry, 38 (12), (pp. 1225-1237); and Singh, P et al (2010) Analytical Chemistry, 82 (7), (pp. 2636-2642). Combined use of MS & X-Ray crystallography methods are described in Montenegro F A et al. Front Physiol. 2017; 8:892.

In aspects, structural similarity is established by application of Fourier-transform infrared (FTIR) spectroscopy, circular dichroism, or a CT. The use of such technologies to determine protein structure, especially secondary structures, is KITA. SFE Arrondo J L et al. Prog Biophys Mol Biol. 1993; 59(1):23-56; Arrondo J L, Goni F M. Prog Biophys Mol Biol. 1999; 72(4):367-405.R; Micsonai A et al. Proc Natl Acad Sci USA. 2015; 112(24):E3095-E3103; and Greenfield, N. Nat Protoc 1, 2876-2890 (2006).

Each of these experimental methods has various strengths and limitations, KITA. For large polypeptides and domains crystallography typically is the method of choice for structure determination. For relatively smaller sequences, such as, e.g., EAT-2 variants (or other sequences of, e.g., about 100-130 amino acids in length), 2-D NMR can also be applied to structure determination. That said, a major advantage of NMR spectroscopy is that it provides information on proteins in solution, as opposed to those locked in a crystal or bound to a microscope grid, and thus, NMR spectroscopy is the premier method for studying the atomic structures of flexible proteins. A typical NMR structure will include an ensemble of protein structures, all of which are consistent with the observed list of experimental restraints.

The output of the various methods described above typically will be a mapping of the atomic positions of the atoms that make up the compared PPTs/AARSs. These atomic positions of the atoms for compared AARSs/PPTs can be compared using any suitable comparison standard and alignment/orientation of atoms, such as root-mean-square deviation of atomic positions (or simply root-mean-square deviation/RMSD). RMSD analytical methods adaptable to AOTI are described in, e.g., Armougom F, et al (2006). Bioinformatics. 22 (14): e35-39; Damm K L et al (2006). Biophys J. 90 (12): 4558-4573; & Maiorov V N et al. (1994). J Mol Biol. 235 (2): 625-634.

In AOTI, structural similarity of AARSs is determined by RMS deviation between corresponding superimposed portions of two determined structures for a variant and parent/referent. In aspects, the coordinates of at least 25, ≥30, ≥40, ≥50, ≥70, ≥80, ≥100, or ≥120 corresponding atoms, and in some cases ≥150, ≥200, or ≥250 corresponding atoms are used to calculate the RMS deviation between compared AARSs. In aspects, the coordinates of generally all, substantially all, or all corresponding atoms in AA backbones are used to calculate an RMS deviation. In certain embodiments, the coordinates of all corresponding alpha carbon-atoms in AA backbones are used to calculate an RMS deviation. In certain embodiments, the coordinates of all corresponding identical residues, including side chains, are used to calculate an RMS deviation.

In certain embodiments, the RMS deviation between the structures of two compared polypeptides or sequences is 3.5 Angstroms (A) or less, about 3 A or less, or about 2.5 A or less. In other aspects, the RMS deviation between two or more similar sequences that can define a subset of suitable variants implicitly provided by a disclosure of any referenced sequence or polypeptide herein is about 2 A or less, about 1.5 A or less, about 1 A or less, 0.75 A or less, 0.5 A or less, 0.3 A or less, 0.2 A or less, or 0.1 A or less.

In AOTI, the structures in the compared ensemble will be very similar to each other in regions with strong restraints. Presumably, areas with fewer restraints are the flexible parts of the molecule, and thus do not give a strong signal in terms of structural similarity. As such, In AOTI, the determination of similarity focuses on those areas that would be considered to be not flexible regions using assessments known in the art.

When a number of structural templates of comparable similarity are available a tool such as MODELLER or a similar comparative modeling program capable of automatically combining a number of template structures can be used to better represent the analysis of structures. Candidate conformations for these regions also can be produced by searching a database of homologous structures for the fragments of identical length that also satisfy the steric constraints for these regions. Both sequence similarity and structural context near the region can be considered in selecting the actual conformation. Side chains within the model can be positioned using a backbone-dependent rotamer library (Bower et al. (1997) J. Mol. Biol. 267: 1268-1282).

Assessment of structural models can be performed techniques KITA. One of these, ProsaII (Sippl (1993) Proteins, 17: 355-362, Aloy et al. (2000) J Comput Aided Mol Des. 14: 83-92), which is used to detect errors in protein structures, creates an energy profile along the sequence of PPTs. Regions that are assigned high energy values by ProsaII serve as good indicators of errors in representing structure of such regions. For detailed checks of modeled structures, the structure verification module of the WHATIF program (Vriend (1990) J. Mol. Graph 8: 52-56) can be used along with visual inspection. If these assessments of model quality identify problems in the modeled structure, appropriate steps (e.g., loop assignment or side chain positioning) can be repeated iteratively until an acceptable quality 3-dimensional model is obtained.

Using these and similarly known methods a computer model of the molecular structure of a referenced polypeptide or domain can be compared with the structure with other biomolecules or sequences. Typically such an analysis is performed by or comprises performing one or more computer modeling methods (e.g., by use of programs such as MACROMODEL™, INSIGHT™, and DISCOVER™, to obtain spatial and orientation requirements for the biomolecules or sequences that are the subject of comparison).

Commercially available or open source software also or alternatively might be used to perform RMS deviation calculations, structural superimpositions, or both. Useful examples include but are not limited to Pymol (Delano Scientific LLC), InsightII and Quanta (both from Accelrys), MIDAS (University of California, San Francisco), SwissPDB viewer (Swiss Institute of Bioinformatics), TOPOFIT (Northeastern University), CBSU LOOPP (Cornell University), and SuperPose (University of Alberta, Edmonton).

In aspects, a PDB model is generated for each of the sequences to be compared and such a PDB model is used to generate a TM-score using the TM score tool available at zhanglab.ccmb.med.umich.edu/TM-score/. One group of variants within the implicit disclosure of any reference provided herein exhibits a TM score of at least 0.5, e.g., ≥0.6, ≥0.7, ≥0.8, or ≥0.9.

In aspects, structural similarity is determined using RMSD analysis along with Global Distance Test (GDT) or Longest Continuous Segment (LCS) analysis methods, wherein multiple superimpositions are generated for each tested structure. Such methods are described in Kufareva I, Abagyan R. Methods Mol Biol. 2012; 857:231-257.

2) Computational Sequence Structure Analysis

Experimental techniques, such as X-Ray crystallography and NMR can be costly, slow, and unusable for acquisition of the structure of some PPTs. As such, In AOTI, assessment of structural similarity AOA is performed by methods comprising or CO computational sequence-based structure prediction.

Aspects of computational sequence-based structure prediction overlap with methods of assessing sequence similarity, e.g., WRT hydrophobicity, charge, residue size/bulk, flexibility, etc. Indexing amino acid sequences on such a basis allows sequences to be characterized and compared to each other and known clusters of similar sequences (SFE Biro J C. Amino acid size, charge, hydropathy indices and matrices for protein structure analysis. Theor Biol Med Model. 2006; 3:15.).

Several tools provide for analysis of sequences on such a basis. For example, the ProtParam program is a web accessible tool which allows the computation of various physical and chemical parameters for a given protein, including molecular weight, theoretical pI, amino acid composition, atomic composition, extinction coefficient, estimated half-life, instability index, aliphatic index and grand average of hydropathicity (GRAVY). In AOTI, a variant will have an instability index score that indicates the variant is a stable sequence when analyzed using this tool (default settings). In AOTI, FVs AOA will have an estimated eukaryotic half-life of at least 10, at least 20, or at least 30 hours. Methods for assessing similarity of peptides in terms of hydropathic properties, weight conservation, and similar considerations are further described in e.g., International Patent Applications WO 03/048185, WO 03/070747, and WO 03/027246.

Other tools provide for the analyses of secondary structure and can be used to define structurally similar variants. For example, In AOTI, variants will comprise most, generally all, substantially all, or all of the secondary structures identified using a secondary structural analysis tool, such as the PROMALS3D sequence and alignment server. In AOTI, the length of such secondary structures varies on average by less than about 33%, less than about 25%, less than about 20%, less than about 15%, or less than about 10% between the secondary structures of the two sequences. Elements of secondary structure also or alternatively can be confirmed by comparison with the results obtained with other additional 2-D structure servers: SSpro8 (Scratch Protein Predictor, scratch.proteomics.ics.uci.edu), NetSurfP ver. 1.1 (at cbs.dtu.dk) and PSIPRED (at bioinf.cs.ucl.ac.uk/psipred).

Structure similarity can be determined using the PROCHECK program (described in, e.g., Laskowski, J. Appl. Cryst., 26, 283-291 (1993)), the MODELLER program, or commercially available programs incorporating such features. Structure predictions can be compared by way of a sequence comparison using a program such as the PredictProtein server (available at http://dodo.cpmc.columbia.edu/predictprotein/). Additional techniques for analyzing protein structure that can be applied to determine structural similarity are described in, e.g., Yang and Honig, J. Mol. Biol., 301(3), 665-78 (2000), Aronson et al., Protein Sci., 3(10), 1706-11 (1994), Marti-Remon et al., Annu. Rev. Biophys. Biomol. Struct., 29, 291-325 (2000), Halaby et al., Protein Eng., 12(7), 563-71 (1999), Basham, Science, 283, 1132 (1999), Johnston et al., Crit. Rev. Biochem. Mol. Biol., 29(1), 1-68 (1994), Moult, Curr. Opin. Biotechnol., 10(6), 583-6 (1999), Benner et al., Science, 274, 1448-49 (1996), and Benner et al., Science, 273, 426-8 (1996), as well as WO 00/45334.

Structural analysis also can be performed by comparison against one or more domain databases which are available in the art. Exemplary database or collections of protein structural elements include but are not limited to the Structural Classification of Proteins (SCOP, maintained by and available through Cambridge University); the database of protein families (Pfam, maintained by and available through the Welcome Trust Sanger Institute); the Universal Protein Resource (UniProt, maintained by and available through the UniProt Consortium); the Integrated resource for protein families (InterPro; maintained by and available through EMBL-EBI); the Class Architecture Topology Homologous superfamily (CATH, maintained by and available through Institute of Structural and Molecular Biology at the University College London); and the families of structurally similar proteins (FSSP, maintained by and available through EBI). Any algorithm deemed suitable by one of skill in the art may be used to select the linker, including but not limited by those used by SCOP, CATH and FSSP. Useful examples of tools/algorithms used for such assessments include Pymol (Delano Scientific LLC), InsightII & Quanta (both from Accelrys), MIDAS (University of California, San Francisco), SwissPDB viewer (Swiss Institute of Bioinformatics), TOPOFIT (Northeastern University), CBSU LOOPP (Cornell University), & SuperPose (University of Alberta).

In AOTI, variants are defined as structurally similar on the basis of exhibiting similar domains with a sufficiently strong score (e.g., an e-value) based on a domain analysis tool. Examples of available domain analysis tools include, e.g., Prosite (prosite.expasy.org/scanprosite), SMART (smart.embl-heidelberg.de), NCBI's Conserved Domain Database (Conserved Domain Architecture Retrieval Tool), INTERPRO (ebi.ac.uk/interpro), ProDom (prodom.prabi.fr/prodom/current/html/home.php), CATH v3.4 on the world wide web at cathdb.info), Superfamily (supfam.cs.bris.ac.uk/SUPERFAMILY), PIRSF (pir.georgetown.edu), and functional searched by PANTHER on the world wide web at .pantherdb.org. The ExPASy bioinformatics portal provides a listing of numerous tools for the evaluation of structure, including various ways to employ PROSITE analysis of sequences (e.g., the PPSearch tool) (see expasy.org/proteomics/families_patterns_and_profiles).

Computer-aided structural similarity analysis of sequences may be established using hidden Markov model (HMM) databases, e.g., InterPro, SMART etc. or position-specific scoring matrix (PSSM)-based databases e.g., NCBI's conserved domain database (CDD). Another tool for structure comparison is the software STRUCTAL, which uses a different similarity measurement than RMSD. See, A. C. M. May. Protein Engineering, 12:707-712, 1999 for a review 37 different protein structure similarity measures ATAOTI.

Amino acid sequences that define a class of suitably structurally similar polypeptides or sequences can be compared by their overall structure, i.e. classifying proteins into a hierarchy to determine similarities. Traditionally, these classifications are done manually with the aid of some automated tools and consider information that biologists have on the function and origin of PPTs. An example of this is the Structural Classification of Proteins (SCOP) database. Another examples is the CATH protein hierarchy, which separates PPTs at level 1 by "class" (i.e. whether the protein contains only alpha helices or beta strands or both), at level 2 by "architecture" (the gross orientation of secondary structures, currently done manually), at level 3 by "topology" (the connections between and numbers of secondary structures), and at the lowest level by "homologous superfamilies" (which takes into account structural & functional similarities between PPTs). Another modeling approach used to define groups of structurally similar sequences is described in Venclovas et al. (1999) Proteins-Structure Function and Genetics, 73-80).

Domain pattern databases that can be used to analyze one or more sequences are available in the art. Examples of such tools include PROSITE, Pfam, SMART, InterPro, PRINTS, and the like. The SWISS-MODEL tool also provides the ability to perform structural homology searching (swiss-model.expasy.org/). Other similar tools are available, at, e.g., https://www.ebi.ac.uk/Tools/pfa/ and several other sites available on the web to those knowledgeable of the art and include the RaptorX tool, raptorx.uchicago.edu/StructPredV2/predict/, the 3D-modeling of the proteins using PHYRE2 Protein Fold Recognition Server, and the TM-Score tool available at zhanglab.ccmb.med.umich.edu/TM-score/. The identification of similar domains by use of any of these tools with significant scores reflecting a high likelihood of the presence of such a domain can also or alternatively be used to define structurally similar variants. Thus, In AOTI, the variants implicitly or explicitly provided herein will exhibit at least one, at least two, or at least three domains, or will exhibit at least 33%, at least 50%, at least 75%, or all of the domains identified for a reference sequence performing an analysis in the same one of these tools. Examples of such analyses are provided further below (e.g., with respect to gD sequence variants).

Predicted structural similarity in a test sequence, such as a variant amino acid sequence, in one aspect means exhibiting one or more of the same domains as a reference amino acid sequence analyzed by the same tool. Typically the determination of domains will be determined by (a) InterPro Scan (ebi.ac.uk/interpro/search/sequence/) or PFAM (pfam.xfam.org/) and also or alternatively (b) NCBI's CDD search tool, or (c) by both positive hits with (a) and (b), wherein the association of both sequences and the one or more domains is associated with an E-value that indicates that the relationship is significant, thereby reflecting the likely presence of the domain. An E-value >10e-100 will typically indicate near certainty of the relationship; 10e-30<E-value<10e-100 indicates the relationship is highly likely; 10e-10<E-value<10e-30 indicates that the relationship is very likely; and at 10e-6<E-value<10e-10 the relationship can be considered likely. For example, HSV-1 gD is identified by Interpro Scan and PFAM submission as possessing a domain according to PFAM family PF01537 ("Herpesvirus glycoprotein D/GG/GX domain") with an E-value of 8e-39 (highly likely) and CDD analysis similarly identified the likely presence of the domain with an E-Value of 4.34e-22 (very likely), whereas HSV-2 gD is associated with this domain with an Interpro Scan/PFAM E-score of 1.2e-37 (highly likely) and a CDD E-value of 5.88e-44 (highly likely). Analysis with these tools can also or alternatively employ bit scores to assess relationship. A bit score of 175 or higher also or alternatively can indicate that the identified/expected domain in a variant also or alternatively maps to the domain or domain family with near certainty, a bit score of 125-175 also or alternatively can indicate the relationship between the program-identified domain and the domain family is at least very likely (e.g., HSV-1 gD exhibits a bit score of 132.6 and HSV-2 gD exhibits a bit score of 128.8 to PFAM family PF01537 according to PFAM analysis), and a bit score of 75-125 can at least indicate that two sequences is likely.

Similar types of analyses with tools can also or alternatively provide a computational indication of structural similarity in one or more domains. For example, raw scores in PROSITE profiles are converted into so-called 'log 10 per residue E-values', which can be indicative of the likelihood of a relationship arising by chance. A normalized PROSITE score of 9.0 or higher, for example, is expected to occur about once in a database of one billion residues. The Motif Scan tool provides automatic results as well as scores, including an automatic "strong match" indication and "strong match for family-specific motif" indication that can be used to determine if two or more sequences comprise similar motifs/domains.

vii. Suitability—Activity of Variants, Homologs, and Fragments

FVs typically retain at least a suitable (or comparable or improved) degree of one or more functional activities exhibited by the referenced sequence or biomolecule. For example, with respect to gD sequences such a function might be the ability to bind HVEM, Nectin-1, or another gD receptor (e.g., Nectin-2) in the case of a gD sequence. With respect to Ag(s) or ITII(s) such a function might be the ability to stimulate an immune response in a host. In the case of an expression-enhancing intron the retained ability will be the ability to detectably enhance expression of the associated coding sequence(s). In the case of a promoter, the function will be the ability to enhance expression of an operatively linked coding sequence.

Given that the functions of the various polypeptide, nucleic acids, and sequences thereof that define the various aspects of the invention vary significantly the tests for the retention or improvement of such functions will also vary accordingly. The function of a polypeptide encoded by a construct, for example, will be specific to the polypeptide and clear from the disclosure provided herein, the art, or both. For example, polypeptides encoded by constructs of the invention can be antigenic and immunogenic polypeptides, which can be used to, e.g., prevent or treat, i.e., cure, ameliorate, lessen the severity of, or prevent a disease regulated by the immune system, such as a pathogenic disease, cancer, or other disorder.

As noted above, variants provided by implicit or explicit disclosure herein can be classified as "functional variants," retaining/possessing suitable biological activity, similar biological activity, or improved biological activity in one or more suitable respects to a WTC. Thus, except where clearly contradicted each referenced sequence or polypeptide herein implicitly provides support for variants that are, e.g., RVRHROSI, SVSHSOCE, or both, and that exhibit one or more biological activities of a referenced wild-type counterpart at a suitable, similar, or improved level.

A "suitable" level of activity in such contexts means at least about 33% of one or more referenced activities is exhibited by the variant (or "is retained" by the variant) if the function is associated with a measurable property. A "similar" or "equivalent" level of activity typically means at least about 75% of the referenced activity (and typically at least about 85%, at least about 90%, or 95-100% of the referenced activity). An "improved" level of activity can be any detectable level of improvement of activity with respect to the function-in-question as compared to the reference sequence, such as a wild-type counterpart of a variant (e.g., about 105% of the typical activity of the referenced biomolecule or sequence). In AOTI, variants are provided that have a significant level of improved activity (a statistically significant improvement). In aspects, variants are provided that have a clinically significant level of improvement (a statistically significant improvement in CEs associated with the variant as compared to the reference AARS/PPT).

Primary functions of the polypeptides, nucleic acid molecules, and sequences that form common elements of the aspects of this invention are provided herein and will be clear in the art. Antigenic sequences, for example, are associated with the primary function of promoting, inducing, or enhancing an antigen response in a subject. ITII sequences exhibit the ability to immunomodulate the activity of one or more innate trained immune cells. Expression-enhancing intron sequences are associated with enhancement of associated coding sequences. PTPS sequences are associated with detectably enhanced levels of proteasomal processing. Some elements can be associated with two or more functions in some cases. For example, a gD sequence or polypeptide can be associated with binding to one, two, or more receptors; with checkpoint inhibition functions; with uptake of associated antigens by target cells; and the like. Such functions can also be defined as higher level functions such as the ability to treat a disease or condition or to induce a protective immune response against a disease-causing agent. Various exemplary tests for such functions (e.g., induction of an immune response, treatment of disease, and the like) are described elsewhere in this description and additional examples of such tests will be known to those of skill in the art.

As is the case with variants, the similarity in function of homologs does not have to be identical, but, rather, only suitably similar. For example, the four known classes of hemoglobins (hemoglobin A, hemoglobin A2, hemoglobin B, and hemoglobin F) are paralogs of each other; but while each of these proteins serves the same basic function of oxygen transport, they have already diverged slightly in function in that fetal hemoglobin (hemoglobin F) has a higher affinity for oxygen than adult hemoglobin. Thus, In AOTI, a suitable FV means a variant that exhibits/retains at least about 35%, at least about 50%, at least about 65%, at least about 75%, at least about 80%, at least about 85%, at least about 90%, or at least about 95% of one or more biological functions of a referenced WTC.

The biological activity of FVs can also be higher than that of the referenced protein, even where the referenced protein is a naturally occurring protein. Indeed, obtaining higher levels of activity is a motivator for generating variants. It also may be the case where, unless otherwise indicated by the description, that a variant, homolog, chimera and the like may exhibit functions that are not exhibited by the referenced polypeptide, nucleic acid, or sequence.

It also can be the case that one (O), some (S), most (M), generally all (GA) (OSMGA), but not all, of the functions of a referenced WTC are exhibited/retained in a variant, substitute homolog, chimera, or the like. For example, a gD homolog might exhibit nectin-1 binding, but not HVEM binding, despite the presence of both functions in the referenced sequence. Where specific functions are required for a class of biomolecules or sequences according to the explicit description provided herein, however, suitable variants also will exhibit such functions at a suitable similar, or improved level, or the level specified by the disclosure, if applicable.

In AOTI, the duration of the retained/exhibited function also can be classified as either suitable, similar, or improved with respect to a referenced naturally occurring protein counterpart. A variant might exhibit, for example, greater stability than a naturally occurring counterpart, resulting in an improvement in duration of a function.

In AOTI, variant sequences are further characterized in not resulting in a detectable, significant, or clinically significant increase in an aspect of toxicity, mutagenicity, genotoxicity, carcinogenicity, teratogenicity, deleterious cross-reactivity, or significant clinical adverse events in subjects of a species or other defined population when the construct encoding the variant sequence(s) is administered in an intended/effective amount under planned administration conditions (dosages, dosage amount, etc.). Methods for the evaluation of such characteristics are well known in the art (SFE the World Health Organization's Guidelines on the quality, safety, and efficacy of biotherapeutic protein products prepared by recombinant DNA technology, who.int/biologicals/biotherapeutics/rDNA_DB_final_19_Nov_2013.pdf?ua=1 and US FDA's Guidance for Industry Preclinical Safety Evaluation of Biotechnology-Derived Pharmaceuticals (and 2011 Addendum)). Such characteristics can also or alternatively be applied to any of the expression products of constructs described herein, to the constructs themselves, and to compositions comprising such constructs (e.g., formulations for delivering expression vectors encoding gDAgFP(s) and optionally other polypeptides).

4. Encoded Amino Acid Sequences and Polypeptides

Constructs can encode a number of AARSs or PPTs or both as well as gDP(s) and Ag(s). Such PPT(s)/AARS(s) are discussed here.

i. Reporter (Marker) and Selection (Resistance) Sequences

In AOTI, constructs include NSs encoding a reporter sequence/polypeptide, a selection sequence/polypeptide, or both. In AOTI, a reporter sequence/polypeptide, a selection sequence/polypeptide, or both, are expressed from the same NAM as another CS, e.g., a glycoprotein D antigen fusion protein encoding sequence (gDAgFPES). In AOTI, a selection sequence/reporter sequence is expressed as part of a fusion protein with other sequences. In aspects, a selection sequence/polypeptide, reporter sequence/polypeptide, or a combination thereof, is expressed from a nucleic acid that is different from the nucleic acid comprising the gD polypeptide-encoding sequence (e.g., the gD:antigen fusion protein-encoding sequence) or is different from any nucleic acid comprising any other encoding sequences, but included in the same composition that is used to transfect target cells.

A "reporter sequence/polypeptide" means any suitable sequence or polypeptide that facilitates detection of the expression product. The use of such sequences/polypeptides are KITA. In some cases, reporter polypeptides are referred to by other names, such as "reporter genes." Such sequences and polypeptides are also sometimes described in the art as "detectable markers," and include a number of readily detectable expression products, such as fluorescent markers or cell surface proteins that can be detected by methods such as flow cytometry. In general, a reporter gene can be any gene that is not present in or expressed by the recipient organism or tissue and that encodes a polypeptide whose expression is manifested by some easily detectable property, e.g., enzymatic activity. Examples of suitable reporter genes may include genes encoding luciferase, beta-galactosidase, chloramphenicol acetyl transferase, secreted alkaline phosphatase, or the green fluorescent protein (GFP) gene (SFE Ui-Tei et al., 2000 FEBS Letters 479: 79-82). Additional reporter genes include glutathione-5-transferase (GST), horseradish peroxidase (HRP), chloramphenicol acetyltransferase (CAT), beta-glucuronidase, luciferase, HcRed, DsRed, cyan fluorescent protein (CFP), yellow fluorescent protein (YFP), and autofluorescent proteins including blue fluorescent protein (BFP). Other common methods include inclusion of reactive sequences such as biotin or avidin or an enzyme/enzyme substrate/reactive group, or chromophore or luminescent compound, such as a bioluminescent, phosphorescent or chemiluminescent compound, and fluorescent compound. Still additional examples include an extracellular domain of human CD2, or a truncated human endothelial growth factor (EGFR) (huEGFRt; see Wang et al., Blood 118:1255, 2011).

In some cases, NAMs/NSs can be labeled, e.g., with detectable nucleotides, such as radionucleotides, or non-radioactive detectable nucleotides or other type of ligand including other molecules or proteins such as, e.g., chemically reactive groups like biotin, streptavidin, or fluorophores. Pre-labeled oligos are available from most oligo suppliers like as IDT DNA or Genewiz and labeling kits are available from ThermoFisher, among others. Inclusion of NSs for rapid hybridization also can act as a marker/label for a nucleic acid.

A "selection sequence/polypeptide" is a sequence that allows the growth of cells transfected with a construct comprising the sequence to selectively grow. Such sequences and polypeptides are well known in the art. Selection sequences/polypeptides are often described in the art as "selection markers." A selection marker can be any coding sequence that allows for selective retention of cells comprising a nucleic acid of interest, e.g. a plasmid, during culturing and propagation in the host cells.

Examples of selectable markers include those genes useful in antibiotic resistance systems, e.g. ampicillin, kanamycin, and neomycin (e.g., a neomycin phosphotransferase marker). Types of selectable markers include those genes useful in antibiotic resistance systems, e.g. amp, kana, neo; in which an operator sequences, e.g. the lac operator or tet operator, placed on a multicopy plasmid, derepresses a chromosomal gene; antidote/poison selection schemes, in which an antidote (e.g. the ccdA gene) to a poison expressed from the host chromosome (e.g. the ccdB gene) is maintained on the plasmid; and those useful in RNA-based selection schemes, e.g. RNAI and RNAII antisense regulators, or antisense regulators that inhibit the translation of a gene that would otherwise promote cell death. Selection markers can include genes to provide a genetic marker for selection and/or evaluation of the cells, such as to assess in vivo survival or localization; genes to improve safety, for example, by making the cell susceptible to negative selection in vivo as described by Lupton S. D. et al., Mol. and Cell Biol., 11:6 (1991); and Riddell et al., Human Gene Therapy 3:319-338 (1992); see also PCT/US91/08442 and PCT/US94/05601 describing the use of bifunctional selectable fusion genes derived from fusing a dominant positive selectable marker with a negative selectable marker. See also, e.g., Riddell et al., U.S. Pat. No. 6,040,177, at columns 14-17.

Constructs can include one or more nonantibiotic resistance markers. In a particular case, such constructs lack any antibiotic resistance markers. In practical terms, such features can be important in, e.g., constructs for administration to NHAs, particularly livestock subjects, where the use of antibiotics is strictly regulated, discouraged, or prohibited. Examples of such selection systems, such as toxin/antitoxin systems, are KITA. SFE Mignon C, et al. Pathogens. 2015; 4(2):157-181.

In AOTI, the constructs comprise a sequence encoding a selection sequence that allows selection by growth in the presence of the non-antibiotic biocide, triclosan (CAS Registry No.: 3380-34-5). Triclosan, a polychlorophenoxy phenol, is formulated in many consumer and industrial products including toothpastes, mouthwashes, soaps, shampoos, deodorants fabric softeners, facial tissues, antiseptics for wound care, and medical devices.

Selection for host cells carrying plasmids can be based on host tolerance to this biocide induced by overexpression of the bacterial gene fabI gene (encoding Enoyl-[acyl-carrier-protein] reductase [NADH]) incorporated into the plasmid. Goh S, Good L. Plasmid selection in *E. coli* using an endogenous essential gene marker. BMC Biotechnol. 2008; 8:61. *Vibrio cholera* FabV, a functional homologue of *E. coli* FabI, also can be used as a suitable marker for selection and maintenance of both high and medium-copy number plasmid vectors in *E. coli* in a triclosan selection system. SFE Ali S A et al. PLoS One. 2015; 10(6):e0129547. CEPESCs can comprise NSs encoding gDAgFP(s) and comprising a triclosan selection marker gene, such as FabI or FabV. In more specific aspects, such a composition comprises nucleotide sequences that comprise EEI(s), a PTPS associated with the fusion protein, an ITICSTAP-encoding sequence, such as an EAT-2 sequence/polypeptide, or a combination of any or all thereof.

ii. Fusion Protein Encoding Sequences (FPESs) and FPSs

In many aspects, CEPs comprise FPs, such as gDAgFPs. In AOTI CEPs can comprise 1, 2, 3, or ≥4 gDPs/gDSs and 1, 2, 3, 4, 5, 6, 8, 10 or more Ag sequences. In aspects, SMGAOA of such gDS(s) and Ag(s) are contained in gDAgFP(s). Other FPs AOA are included in certain AOTI, such as in compositions or methods in which a targeting domain is incorporated into a second fusion protein-coding sequence, such as a innate trained immunity cell targeting sequence, such as a dendritic cell targeting sequence, such as a DEC-205 binding sequence, e.g., a DEC-205-binding trap protein, DFEH.

In general, a "fusion protein" refers to any polypeptide that, in at least one single chain, has at least two distinct, typically heterologous sequences (which are sometimes variously described herein and in the art as parts, portions, sections, ends, partners, or domains of the fusion protein), wherein the domains are not naturally found together in a protein. Typically, the different portions of the fusion protein each have at least one distinct function. For example, in the case of a gD:antigen fusion protein, the gD portion(s) of the fusion protein impart receptor targeting functions and the antigen sequences induce certain immune responses. The term "domain" is sometimes used in connection with fusion protein to refer to such portions, but the use of the term domain in such contexts is not meant to imply or require the presence of a secondary, tertiary, or quaternary structure.

A nucleic acid molecule encoding a fusion protein may be constructed using polymerase chain reaction (PCR) methods, recombinantly engineered, or the like, or prepared through nucleotide design and synthesis.

In certain embodiments, a fusion protein expressed or produced by a host cell (e.g., a DC or a T cell) locates to the cell surface, where the fusion protein is anchored to the cell membrane with a portion of the fusion protein located extracellularly (e.g., containing a binding domain) and a portion of the fusion protein located intracellularly (e.g., containing a signaling domain). A fusion protein can be engineered to include an EL of a PPT or only an FF of a PPT. The joining of the two or more genes expressing a FP may be made in any order, though in certain cases the placement of certain domains is preferably in a specific order, as will be indicated in the description of certain AOTI.

In addition to the specific FP component sequences described herein, additional heterologous AARSs can be included in FPs without impairing the functions of the other domains. For example, a technician or researcher may add to the nucleotide sequence a sequence that encodes a "tag" or "handle," which can be used to facilitate isolation of a fusion protein (e.g., a FLAG peptide, SFE Einhauer A et al. J Biochem Biophys Methods. 2001; 49(1-3):455-465.) (see also Terpe K. Appl Microbiol Biotechnol. 2003; 60(5):523-533). Reporter sequences, as described above, are another example of a sequence that is regularly added to FPs to enable location of the FP in a cell or tissue.

iii. Linkers

AARSs that form part of a FP can be linked directly or indirectly. An "indirect link" means the 2+ referenced AARSs are joined through an intervening amino acid residue or an amino acid sequence. Such an intervening residue or sequence is typically in the art and herein referred to as a "linker" or a "spacer" (or "tether"). Terms such as "linked" and "fused" are used interchangeably here to refer to the joining of any 2 sequences/parts.

The primary purpose of a linker typically is to create space between the two referenced AARSs that the linker links so as to ensure that the referenced parts/domains of the fusion protein can exhibit their intended functions. In AOTIs, linkers may be sufficiently large, sufficiently flexible, or both to allow the linked reference sequences to function more effectively than compared to corresponding no linker or smaller linker FPs. A linker typically primarily comprises or generally consists of uncharged amino acid residues. A linker typically does not significantly negatively impact the functioning of any AARSs it fuses. In other aspects, the linker also or alternatively reduces the immunogenicity associated with the fusion of the two referenced sequences.

A fusion protein, such as a gD:antigen fusion protein of the invention can comprise any suitable number of linkers between the various referenced amino acid sequences of the fusion protein. Thus, for example, a gD:antigen fusion protein can comprise one, two, three, or more gD sequences, one, two, three, four, five, six, seven, eight, nine or more antigenic sequences, and possibly other sequences, such as one or more PTPSs, endoplasmic reticulum (ER) targeting/processing sequences (ERTPSs), or a combination thereof, wherein the fusion protein comprises two, three, four, five, six, seven, eight, nine, 10, 11, 12, 13, 14, or 15 linkers.

A linker typically will primarily comprise, GCO, consist essentially of, or consist of a sequence of two or more neutral polar or nonpolar amino acids. Linkers can be any suitable length. A linker can be, for example, 2 to about 100 amino acids in length, such as between 2-, 3-, and 4- and about 20-, 35- or –50 AAs in length, e.g., 3, 5, 10, 15, 20, 25, 30, 35, 40, 45, or 50 AAs in length (e.g., 2-28, 2-22, 2-18, 2-14, 2-12, 2-10, 2-8, 3-12, 3-15, 3-18, 3-21, 3-9, 4-8, 4-6, 4-12, 4-16, 4-20, 5-20, 5-15, 5-20, or 5-25 AAs in length). An exemplary, non-limiting linker is an AARS comprising at least 2 residues, ≥3 residues, ≥4 residues or ≥5 AAs and is flexible, hydrophilic, and has little or no detectable secondary structure of its own. When multiple linkers are used to interconnect portion of the molecule, the linkers may be the same or different (e.g., the same or different length and/or amino acid sequence).

In AOTI, a linker can be "cleavable," for example, by auto-cleavage, or enzymatic or chemical cleavage. Cleavable linkers typically contain at least one bond that can be selectively cleaved by a cleavage reagent. Such linkers may be engineered, e.g., to contain protease cleavage sites, so that cleavage occurs in the middle of the linker or in at least one end of the linker. For example, thrombin sites may be engineered at each of the two flanking ends of a linker. Depending on the type of linker used, cleavage may also be mediated by agents such as TCEP, TFA, and DTT. Linkers may be designed so that cleavage reagents remove all residues from the linker from the cleavage product. Other exemplary non-limiting linkers include prodrug linkers whose bonds can be selectively cleaved under in vivo conditions, for example, in the presence of endogenous enzymes or other endogenous factors, or simply in aqueous fluids present in the body or in cells of the body. Cleavage sites in amino acid sequences and enzymes and chemicals that cleave at such sites are well known in the art and are also described further elsewhere herein.

In aspects, OSMGAOA of the linkers of a fusion protein do not contain cleavage sites. Such aspects may be useful in cases where it is desired that the fusion protein construct will remain fused longer.

Linkers occur naturally in some fusion proteins, such as antibodies, and any such naturally occurring linkers can be incorporated, where suitable, into a fusion protein of the invention. Naturally occurring linkers typically form a detectable coiled structure and comprise, and typically comprise, are at least 25% composed of, are at least 33% composed of, are at least 50% composed of, or are at least 75% composed of one or more of Gln, Arg, Glu, Ser, and Pro amino acid residues. One, some, most, generally all, or all of the linkers also can be artificial linkers, examples of which are provided herein.

"Flexible" linkers, which are typically composed of combinations of glycine and/or serine residues, can be advantageous in some aspects. Examples of such linkers are described in, e.g., McCafferty et al., Nature, 348, 552-554 (1990), Huston et al., Proc. Natl. Acad. Sci. USA, 85, 5879-5883 (1988), Glockshuber et al., Biochemistry, 29, 1362-1367 (1990), and Cheadle et al., Molecular Immunol, 29, 21-30 (1992), Huston et al., Proc. Natl. Acad. Sci. USA, 85, 5879-5883 (1988), Bird et al., Science, 242, 423-26 (1988), and U.S. Pat. Nos. 5,672,683, 6,165,476, and 6,132, 992.

Exemplary linkers, especially flexible linkers, may comprise one or more glycine residues, one or more serine residues, or a combination thereof (e.g., one or more units of (Gly-Ser)n residues, where n is a number between 1 and 10, such as 1-5). Exemplary linkers also can comprise from about one to about ten repeats of a sequence according to the formula $Gly_xSer_y$, wherein x and y are each independently an integer from 1 to 5. In certain embodiments, the linker can comprise more glycine residues than serine residues, e.g., by comprising a (GxS)y sequence, wherein x and y are integers, wherein x=1, 2, 3 or 4, and wherein y=1, 2, 3, 4, 5, 6, or 7. In another exemplary aspect, a fusion protein expressed by a construct comprises a linker sequence that comprises a (G-G-G-G-S)x, amino acid sequence where x is a positive integer. In another aspect the fusion protein comprises one or more linkers according to (GGGGS)n (SEQ ID NO:459), where n is 1, 2, 3, 4, 5, 6, 7, or 8. In AOTI, the fusion protein of the invention comprises one or more linkers comprising one or more Gly residues. In aspects, FP(s) comprises one, two, three or more Gly-rich linkers (at least primarily comprises of Gly residues) or the linkers of the fusion protein primarily comprise, generally consist of, or consist of Gly-rich linkers. In AOTI, 1, ≥2, primarily all, generally all, or all linkers of a FP encoded by a construct are at least 60% Gly in composition. In AOTI, one, two, primarily all, generally all, or all of the linkers of a fusion protein comprise at least 33% Gly residues. Gly residues have a low preference to form an a-helix; thus, the lack of a sidechain maximizes the freedom of the backbone. Accordingly, In AOTI, the invention provides FPs comprising one or more Gly-containing or Gly-rich linkers that exhibit greater rotational freedom of the linked domains, lack of an alpha helix in or around the linker, or both.

In aspects, FP(s) comprise linkers comprising Ser residue (s), Thr residue(s), or a combination thereof. Ser and Thr are polar residues that typically prefer to interact with the solvent rather than with the fused domains. Accordingly, the invention provides fusion proteins comprising one, two or more, or three or more linkers comprising Thr or Ser, primarily comprising Thr or Ser, or generally consisting of Thr or Ser residues, as well as fusion proteins wherein the linkers of the fusion protein are mostly composed of, generally consist of, or consist of such Ser/Thr linkers, wherein the fusion protein exhibits detectably enhanced solubility due to the presence of the linker.

Linkers comprising a greater percentage of Ala or Ser residues typically show more stability than Gly-rich linkers. Stable linkers that can be incorporated into FPs can be formed from a mixture of such residues (Ala and Gly, Ser and Gly, or Ala, Gly, and Ser) or from only Ala/Ser residues.

In AOTI, the invention provides constructs encoding one or more FPs comprising Ser/Thr comprising linkers or Ser/Thr rich linkers, or a CT, which exhibit detectably enhanced, and in some aspects significantly enhanced resistance to proteolysis as compared to other linkers or that cause the fusion protein to exhibit enhanced, in some cases significantly enhanced, resistance to proteolysis (e.g., in the subject vertebrate). On example of a very stable linker is a mixture of about 11 Ala (e.g., 9-12 Ala residues) and about 5 Gly residues (4-6 Gly residues). Another example is a mixture of about 7 Ser (e.g., 5-8 Ser residues) and about 9 Gly residues (e.g., 8-10 Gly residues).

In AOTI, constructs of the invention encode fusion proteins comprising 1-25, 1-20, 1-15, 1-10, 1-8, or 1-5 linkers, such as 2-24, 2-18, 2-16, 2-12, 2-10, 2-8, or 2-6, or 3-21, 3-15, 3-12, 3-9, or 3-6 linkers, which linkers comprise 2-32 residues, commonly 2-20 residues, often 3-21 residues, 4-20 residues, 4-16 residues, or 4-12 residues, at least 33% of which or at least 50% of which are Gly residues, and optionally at least 10%, at least 20%, or at least 33% of which are Ser, Thr, or a mixture thereof.

Additional exemplary flexible linkers that can be in FPs OTI include linkers comprising, GCO, or consisting of a sequence according to one of the following formulas: (GGGGS)n wherein n is 1-8, 1-6, 1-4, 1-3, 2-3, or 3; GGGS (SEQ ID NO: 460)), with n being 1-10, 1-6, or 1-3; SGGG (SEQ ID NO: 461))n with n being 1-10, 1-6, or 1-3; $(Gly)_{2-12}$, (e.g., $Gly_4$, $Gly_3$, $Gly_6$, and $Gly_8$). Specific examples of such linkers include SEQ ID NOs: 458-474 and SG, and linkers including CTs or repeats thereof (e.g., 2×, 3×, or 4× of any thereof).

In AOTI, linkers in FPs PC, GCO, or CO linkers that are ≥3 AAs in length. In AOTI, linkers of FPs are ≥4 AAs in length, e.g., ≥5 AAs in length.

In aspects, FPs comprise linker(s) that comprises 1+ Ala residues. In AOTI, such a linker is longer than 2 residues in length, such as Ala-Ala-Ala (AAA) or SEQ ID NO:475. In AOTI, the fusion protein comprises a linker that comprises Ala residues mixed with other types of amino acid residues.

In some aspects, such a linker may comprise one or more Glu or one or more Lys residues dispersed throughout the Gly, Ser, or Gly-Ser mixture to increase solubility of the linker. Glu or Lys residues also can be incorporated in Ala-comprising or Ala-rich residues. Tyr residues can be incorporated into either such type of linker sequence.

In AOTI, the fusion protein comprises one or more linkers comprising Ala and at least one Glu (E) residue, at least one Tyr (Y) residue, or a combination thereof. Such linkers are typically considered rigid or at least relatively more rigid and associated with less rotation/free movement than the flexible linkers described above. Examples of such "rigid" linkers include linkers according to the formulas: (EAAAK (SEQ ID NO:476))$_{1-4}$, SEQ ID NO: 477, and A(EAAAK)$_{1-4}$ALEA(EAAAK)$_{1-4}$A, e.g., SEQ ID NO:478. Linkers with similar compositions include SEQ ID NOs: 479 and 480.

Other linkers can comprise Pro residue(s). Such linkers are also typically rigid or relatively rigid (e.g., as compared to a flexible linker). An example of such a linker is SEQ ID NO:481. In AOTI, such a linker PC, GCO, or CO Gly & Pro AAs or Ala & Pro AAs. Longer Pro-containing linkers can form loop structures, which can be incorporated into fusion proteins of the invention. An example of such a linker is SEQ ID NO:482, which forms a 281 degree turn loop. EPs associated with similar linkers that can form 90+, 120+, 150+, 180+, 210+, 240+, or 270+ degree turns are AOTI.

Still other linkers comprise F, L, I, or V residues in combination with any of the residues discussed above. Examples of such linkers include G-F-L and G-F-L-G (SEQ ID NO:483) linkers, A-L-A-L (SEQ ID NO:484) linkers, V-A linkers, V-K linkers, V-K linkers, V-C inkers, and V-R linkers, and mixtures or repeats thereof (e.g., repeats of 2×, 3×, 4×, or 5× thereof or of a mixture of any thereof). Other examples of such linkers include SEQ ID NOs: 485-487 and GIG, and repeats/combinations thereof. In aspects, such linkers can further include an Arg residue (e.g., a RIG sequence linker).

In some aspects, linkers also or alternatively may contain cysteine residues, for example, if dimerization of linkers is used to support or facilitate multimerization of a multimeric polypeptide (e.g., a Trap protein, examples of which are discussed further herein) into its properly folded configuration. Such linkers may also or alternatively comprise a longer multimerization domain or a domain that contributes to multimerization.

In certain embodiments, linker(s) comprise a glycosylation sequence. In certain embodiments, the linker comprises an amino acid sequence according to Asn-Xaa-Ser/Thr/Cys where Xaa is any amino acid or, in certain embodiments, wherein Xaa is any amino acid except Pro and Ser/Thr/Cys is serine, threonine or cysteine. In certain embodiments, the linker comprises the amino acid sequence Asn-Ala-Ser. In certain embodiments, the linker is a glycosylation sequence. In AOTI, linker(s) comprise AARSs according to Asn-Xaa-Ser/Thr/Cys where Xaa is any AA or, in certain embodiments, wherein Xaa is any amino acid except Pro and Ser/Thr/Cys is serine, threonine or cysteine. In certain embodiments, the linker is the amino acid sequence Asn-Ala-Ser. However, in other aspects, most, generally all, or all of the linker sequences of the fusion protein are free of any potential glycosylation sites.

Additional examples of suitable linkers are generally described in, e.g., U.S. Pat. Nos. 5,990,275, 6,010,883, 6,197,946, and EP 0 035 384. If separation of AARSs is desirable, a linker that facilitates separation can be used in FPs. An example of such a linker is described in U.S. Pat. No. 4,719,326. Additional PMCs are described in, e.g., Schellenberger et al., Nature Biotechnol. 27:1186-1190, 2009; Sickmeier et al., Nucleic Acids Res. 35:D786-93, 2007); Chen X, et al. Adv Drug Deliv Rev. 2013; 65(10): 1357-1369; Arai R et al. Protein Eng. 2001; 14(8):529-532. doi:10.1093/protein/14.8.529; & Reddy Chichili V P et al. Protein Sci. 2013; 22(2):153-167. Any suitable linkers from these source or other sources KITA can be incorporated where suitable. As such, FPs can comprise one or more "linking means", such as a "flexible linking means" or a "rigid linking means", which will, in such contexts, refer to the linkers provided herein and their equivalents KITA.

In AOTI, a gDAgFP or other FP EP will comprise 1+ linkers that are at least four amino acids in length and that detectably enhances one or more antigen-specific immune responses to one or more Ags in the fusion protein or other expression product as compared to a corresponding fusion protein comprising only a 2-residue (two-mer) or 1-residue linker or lacking any linker.

In AOTI, constructs comprise a furin-sensitive linker (e.g., SEQ ID NO:488) or furin-resistant linker (e.g., SEQ ID NO: 489). In aspects, linker(s) include linkers including glycosylation site(s) (e.g., SEQ ID NOs: 490-493).

iv. Cleavage Sites

In aspects, FPs comprise ≥1 cleavage sites that facilitate the separation of referenced sequences/domains. A cleavage site is a sequence that is specifically targeted and cleaved by an enzyme or a limited set of enzymes (a "cleavage partner"). The introduction of cleavage sites can be used to facilitate breaking up the fusion protein into two or more parts.

A fusion protein can comprise any suitable number of cleavage sites (which are sometimes also called "cleavage signals"). For example, a fusion protein can comprise one, two, three, four, five, or more cleavage sites (e.g., 1-10, 1-8, 1-6, 1-3, or 1-2 sites). A cleavage site may be located at the N-terminus, the C-terminus, between the N- and the C-termini, e.g., about half-way between the N- and C-termini, between the N-terminus and the mid-point, between the halfway point and the C-terminus, or CT.

Cleavage sites of FPs may be any suitable type of cleavage sites. Numerous types of cleavage signals are KITA. Examples include proprotein convertase (or prohormone convertase), thrombin, and Factor Xa protein cleavage signals. Another example is a furin cleavage site. Examples of such cleavage sites are described in, e.g., U.S. Pat. No. 7,374,930, US20090227660 & Jenny R J, et al. *Protein Expr Purif.* 2003; 31(1):1-11. Additional known cleavage sites include GSF-S-S-Tf, IFN-α2b-HAS, FIX-albumin (e.g., VSQTSKLTRIAETVFPDV, SEQ ID NO: 494) (the down arrow indicating the point of cleavage); LAP-IFN-β; MazE-MazF (e.g., PLG↓LWA, EDVVCC↓SMSY, and GGIEGR↓GS) (SEQ ID NOS: 495-497), immunotoxin (e.g., TRHRQPR↓GWE, AGNRVRR↓SVG, RRRRRRR↓R↓R, and GFLG↓ (SEQ ID NOs: 498-501), and G-CSF-Tf and hGH-Tf cleavage sites, which are variously cleavable by protease, Factor Xia/FVIIa, Matrix metalloprotease-1, HIV-1 protease, NS3 protease (HCV protease), Factor Xa, Cathespin B, and Furin. An example of a factor Xa-sensitive cleavage site is SEQ ID NO:502 (see, for example, Nagai and Thøgersen (1984) Nature 309:810-812, Nagai et al (1987) Meth. Enzymol. 153:461-481, & Pryor and Leiting (1997) Protein Expr. Purif. 10(3):309-319. Examples of thrombin-sensitive cleavage sites include SEQ ID NOs: 503 and 504 (SFE Pryor and Leiting (1997) Protein Expr. Purif. 10(3):309-319, & Hong et al. (1997) Chin. Med. Sci. J. 12(3):143-147). Cleavage sites for TEV protease also are KITA (SFE U.S. Pat. No. 5,532,142). Additional cleavage site-directed enzymes that act on known cleavage sites include tobacco etch virus protease, trypsin proteases, SUMO proteases, Human Rhinovirus HRV2C proteases, enterokinase, V8 protease, α-lytic protease, etc. Cleavage sites for these enzymes also are KITA.

In methods, FPs comprising 1+ of these or similar cleavage sites can be co-administered with the cleavage partner or with a nucleic acid that encodes the cleavage partner to promote the cleavage of the referenced sequences or domains. In aspects, the invention provides compositions comprising nucleotide sequences that encode at least one cleavage site and at least one cleavage partner, which facilitates cleavage of the fusion protein.

a. "Self-Cleavage" Sites (SCSs)

In AOTI, FPs encoded by constructs comprise one or more "self-cleavage" sites ("SCSs"), such as a 2A self-cleaving peptide site. 2A sequences can induce the cleavage of a recombinant protein following expression without requiring the expression or co-administration of a cleavage partner. Although these sequences are known in the art as "self-cleavage" peptides, it is believed that they are likely cleaved through internal processes of the cell. Regardless of how cleavage occurs with such sequences, a "self-cleavage" site herein means any cleavage site that is effective at specifically inducing the cleavage of the fusion protein at the site without the co-administration or co-expression of a cleavage partner/enzyme.

In one aspect the fusion protein comprises 2A cleavage site(s), such as 2, 3, 4, 5, or more cleavage sites. In AOTI, one, some, most, or all of the 2A cleavage sites are selected from P2A, E2A, F2A and T2A cleavage sites (e.g., SEQ ID NOs:505-508, respectively).

In AOTI, OSMGAOA 2A sequences incorporated in FP(s) are a T2A or a P2A sequence. An exemplary T2A sequence is incorporated into some of the exemplary vector constructs described in detail in this description.

In AOTI, a linker, such as a flexible linker, is added to the N terminus, C terminus, or both, of SMGAOA of the 2A sequences incorporated into FPs. For example, In AOTI, the sequence GSG is added to the N-terminus, C-terminus, or both of a 2A sequence, such as one of the sequences described in this paragraph. In AOTI, the addition of the linker detectably or significantly enhances the rate of cleavage of the fusion protein.

In aspects, self-cleavage site(s) AOA are associated with a $2^{nd}$ cleavage site that can be acted on by a cleavage partner. In one example, a FP comprises a 2A self-cleavage site in addition to a furin cleavage site. In such aspects, a method of the invention can comprise administering the cleavage partner or a composition can comprise a sequence encoding the fusion partner.

Although FPs can comprise multiple self-cleavage sites, some 2A systems have been associated with lower levels of expression of intended final products in multi-cistronic systems. As such, In AOTI, the fusion protein will comprise only one 2A site. However, recent research is demonstrating that bicistronic, tricistronic, and even quadcistronic 2A systems (such as TPE2A sequences) can be useful and that other 2A systems are more effective than others in such systems. Liu Z et al. Sci Rep. 2017; 7(1):2193. Published 2017 May 19. Related PMCs are further described in, e.g., Szymczak-Workman, A. L et al (2012). Cold Spring Harbor Protocols. 2012 (2): 199-204. ISSN 1559-6095 and Thiel, Volker (ed.). PLoS ONE. 6 (4): e18556.

Another type of self-cleavage sequence is an intein sequence, which provides polypeptide splicing-like functionality. In another aspect of the invention, cleavage products, modified products, and even combinations thereof can be obtained by expressing polypeptides with intein sequences contained in the fusion protein, and such means/methods may be used to obtain multiple expression products and, thus, incorporated into fusion proteins and encoded by constructs of the invention. Application of intein technology to such ends has been exemplified in the art and other applications of intein sequences in fusion protein are also known. SFE Zhang B, et al. Sci Rep. 2015; 5:8541. Published 2015 Feb. 25 & US20200002743A1. Intein sequences also have been successfully used to re-fuse separately expressed sequences, and such sequences can AOA be incorporated into or used in other method/compositions AOTI, e.g., as a strategy for overcoming packaging size limitations of viral vectors, a method KITA (e.g., with AAV vectors).

b. IRES Elements

Translation in eukaryotes usually begins at the 5' cap so that only a single translation event occurs for each mRNA. However, some bicistronic vectors take advantage of an element called an Internal Ribosome Entry Site (IRES) to allow for initiation of translation from an internal region of the mRNA. An IRES is an RNA domain which enables efficient translation of an mRNA lacking a 5' cap structure. IRES elements have now been found in many different viral families where they often confer a selective advantage to allow ribosome recruitment under conditions where cap-dependent protein synthesis is severely repressed. In one aspect of the invention a nucleotide sequence, such as a nucleotide sequence incorporated into a viral vector or nucleic acid vector, such as an RNA vector comprises one or more IRES elements. In AOTI, such a construct comprises one or more IRES elements that are highly identical, substantially identical, or comprise a sequence identical to at least a functional portion of a naturally occurring virus from an RNA positive stranded virus. In AOTI, the IRES is an IRES isolated from or that is at least highly identical or substantially identical to a naturally occurring IRES that occurs in picornaviruses, flaviviruses; dicistroviruses; or a lentiviruses. IRES elements are generally described in, e.g., Balvay L, Soto Rifo R, Ricci E P, Decimo D, Ohlmann T. Structural and functional diversity of viral IRESes. Biochim Biophys Acta. 2009; 1789(9-10):542-557. An IRES element can act as another ribosome recruitment site, thereby resulting in co-expression of two proteins from a single mRNA. Thus, In AOTI, the constructs of the invention are multi-cistronic, at least in part, due to the incorporation of one or more IRES sites. In AOTI, the vector or construct comprises only one IRES element, such that the construct or vector is a bicistronic construct/vector. Examples of bicistronic vectors comprising IRES elements are described in, e.g., Santana V C, Diniz M O, Cariri F A, et al. Bicistronic DNA vaccines simultaneously encoding HIV, HSV and HPV antigens promote $CD8^+$ T cell responses and protective immunity. PLoS One. 2013; 8(8):e71322; Harries M et al. J Gene Med. 2000; 2(4):243-249. However, in other aspects multiple IRES are contained in a construct to make or contribute to a multi-cistronic expression property of the construct. Such constructs are known in the art (SFE Yeo J H M et al. Methods Mol Biol. 2018; 1827:335-349). In AOTI, an IRES-comprising vector is a non-viral vector (e.g., in one AOTI provides a multi-IRES vector that is a non-viral vector).

In AOTI, vectors or constructs of the invention incorporate two or more means for providing multi-gene/multi-cistronic expression, such as a splicing sequence and an IRES, an IRES and a 2A peptide, a bidirectional promoter and one or more 2A sequences, or multiple expression cassettes at least one of which comprise an IRES, splicing signal, or 2A sequence. In one exemplary aspect, constructs/vectors comprise 1+2A peptides and 1+ IRES elements. In one such example, a construct produces ≥three EPs from a single transcript due to the coordination of 2A sequence(s) and an IRES.

v. Signal/Leader Sequences

As noted above, a coding sequence can encode an immature protein that is subsequently processed in the cell or tissue in which it is expressed. One element of an immature protein of functional significance in aspects of the invention is a signal sequence (sometimes also called a "leader sequence" and which may also be referred to as secretory peptide/sequence or signal peptides). Signal sequences can direct the transport of an associated immature polypeptide within or from a cell. For example, such sequences can direct secretion of a polypeptide encoded by a nucleic acid fragment or polynucleotide of the present invention from a cell. A signal sequence typically will be located in the N-terminus of the polypeptide, which is cleaved from the complete or "full length" polypeptide to produce a secreted or "mature" form of the polypeptide. In some cases, such sequences are cleaved from a mature or intermediate form of a protein once export of the growing protein chain across the rough endoplasmic reticulum ("ER") has been initiated. In certain embodiments, a native leader sequence is expressed with an associated polypeptide sequence (as is the case in certain embodiments of the invention wherein a gD leader sequence or highly homologous variant thereof is expressed along with other gD sequences, such as a gD:antigen fusion protein). In other aspects, constructs of the invention include a heterologous leader sequence (with respect to the associated mature protein). For example, a gD leader sequence can be associated with other sequences, such as one or more antigen sequences. Other leader sequences are known in the art and can be used, where suitable, to develop other heterologous leader sequence/mature polypeptide combinations, including the human tissue plasminogen activator (TPA) leader sequence and mouse β-glucuronidase leader sequence. Signal peptides may be employed that direct transmembrane proteins to the cell surface or different signal peptides may be used that promote the secretion of a soluble form of the protein. A variety of secretion signal sequences are described in the art and several examples of such sequences are now contained in the Signal Peptide Database. The use of gD signal sequences is specifically discussed further below. Further examples of signal sequences are described in, e.g., U.S. Pat. Nos. 4,690,898, 5,284,768, 5,580,758, 5,652,139, & 5,932,445. Suitable signal sequences can be identified using e.g., the SignalP program (described in, e.g., Nielsen et al. (1997) Protein Engineering 10:1-6), available through the Center for Biological Sequence Analysis at services.healthtech.dtu.dk/service.php?SignalP-5.0. Sequences can be manually analyzed to identify signal sequences, as described in, e.g., EP 0 621 337, Zheng and Nicchitta (1999) J Biol Chem 274 (51): 36623-30, and Ng et al. (1996) J Cell Biol 134(2): 269-78.

vi. Targeting Domains/Sequences

Constructs of the invention can also or alternatively encode fusion proteins comprising one or more targeting domains/sequences (which also sometimes and in some contexts are referred to as "localization sequences", "targeting domains", and the like), that can, at least in some cases, be considered distinct from classical signal sequences (discussed above), but which also can direct the transport of the associated polypeptide, processing of the polypeptide to cells within an organism, in the cell, or both.

Distinctions between such sequences and typical signal sequences include targeting of a specific organelle outside of the secretion organelles, targeting of particular cellular receptors (and thus, cells), often having larger or smaller lengths than typical signal sequences (less than the 15-30 amino acid length associated with most signal peptides or more than about 30 amino acids in some cases), placement of the targeting sequence outside of the N-terminus of the polypeptide, lack of cleavage from the polypeptide, or a combination of any or all thereof. Thus, such distinctions may not be binding.

EP(s) can comprise targeting sequences (TS(s)) (e.g., PTPS sequences and gD sequences that bind to particular receptors). FPs expressed by constructs included in compositions of the invention can also or alternatively, typically alternatively, target any other suitable target, whether intracellularly or extracellularly. FPs expressed by constructs in CEPESCs that comprise TS(s) other than gD RBD sequences can still include gD sequences (e.g., a gD profusion domain sequence, a gD signal sequence, or both) or such fusion proteins can lack any gD sequences, e.g., where such a fusion protein is encoded by a second NAM of a composition and expressed in combination with a gD:antigen fusion protein. Examples of non-gD extracellular molecules that can be bound by non-gD targeting sequences included in fusion proteins expressed by constructs of the invention include, e.g., include MHC class I, MHC class II, CD1, CD2, CD3, CD4, CD8, CD11b, CD14, CD15, CD16, CD19, CD20, CD29, CD31, CD40, CD43, CD44, CD45, CD54, CD56, CD57, CD58, CD83, CD86, CMRF-44, CMRF-56, DCIR, DC-ASPGR, CLEC-6, CD40, BDCA-2, MARCO, DEC-205, mannose receptor, Langerin, DECTIN-1, B7-1, B7-2, IFN-γ receptor and IL-2 receptor, ICAM-1, Fcγ receptor, T cell receptor, or lectin, or any of the other various immune cell receptors described herein. In AOTI, a composition comprising sequences encoding a gD:antigen fusion protein and a non-gD targeting sequence: antigen fusion protein (e.g., a DEC-205-binding:antigen fusion protein expressed by one NAM and a gD:antigen fusion protein expressed by a second NAM of a composition).

As noted above, a targeting sequence can target an intracellular target, such as an organelle (e.g., the ER or the proteasome) or an extracellular target, such as a receptor on a cell that is different from COE (e.g., a dendritic cell receptor). A composition of the invention can comprise nucleotide sequences encoding one or more of each type of targeting sequence or a combination of such targeting sequences (e.g., in one aspect a fusion protein comprises (a) at least one extracellular targeting sequence, such as dendritic cell receptor-binding sequence, which can be a gD sequence or a heterologous dendritic cell receptor binding sequence, and (b) at least one intracellular targeting sequence, such as a PTPS or endoplasmic reticulum targeting/processing sequence (ERTPS)). A fusion protein can also comprise a signal sequence in addition to an intracellular targeting sequence, extracellular targeting sequence, or a combination thereof.

For example, a vector of the invention, such as a viral vector, can include a nucleotide sequence encoding a genetically engineered antigen receptor, such as a chimeric antigen receptor (CAR) (vector targeting is also discussed elsewhere herein). Other examples of localization sequences that can be encoded by constructs of the invention include, e.g., a nuclear localization sequence, an endoplasmic reticulum localization sequence, a peroxisome localization sequence, or a mitochondrial localization sequence. Localization sequences are known in the art and are described in, e.g., "Protein Targeting", chapter 35 of Stryer, L., Biochemistry (4th ed.). W. H. Freeman, 1995. Examples of known localization sequences include those targeting the nucleus (e.g., SEQ ID NO:509), mitochondrion (SEQ ID NO:510), endoplasmic reticulum (KDEL (SEQ ID NO:511)), peroxisome (SKF), prenylation or insertion into plasma membrane (CAAX (SEQ ID NO:512), CC, CXC, or CCXX (SEQ ID NO:513)), cytoplasmic side of plasma membrane (fusion to SNAP-25), or the Golgi apparatus (fusion to furin). Other examples of heterologous signal peptides that are functional in mammalian host cells include the signal sequence for interleukin-7 (IL-7) described in U.S. Pat. No. 4,965,195; the signal sequence for interleukin-2 receptor described in Cosman et al., Nature 312:768 (1984); the interleukin-4 receptor signal peptide described in EP 367,566; the type I interleukin-1 receptor signal peptide described in U.S. Pat. No. 4,968,607; and the type II interleukin-1 receptor signal peptide described in EP 460,846. Polypeptides expressed from constructs of the invention can include an intracellular targeting sequence (or "sorting signal") that directs the polypeptide to an endosomal and/or lysosomal compartment(s), for example a compartment rich in MHC II to promote CD4+ and/or CD8+ T cell presentation and response, such as a lysosomal/endosomal-targeting sorting signal derived from lysosomal associated membrane protein 1 (e.g., LAMP-1-SFE Wu et al. Proc. Natl. Acad. Sci. USA 92:1161-75 (1995) and Ravipraskash et al., Virology 290: 74-82 (2001)), a portion or homolog thereof (SFE U.S. Pat.

No. 5,633,234), or other suitable lysosomal, endosomal, and/or ER targeting sequence (SFE U.S. Pat. No. 6,248, 565). Additional examples of targeting sequences include endoplasmic reticulum (ER) targeting/processing sequences such as SEQ ID NO: 511), lysosomal targeting sequences, such as SEQ ID NO:514, or other ER or Golgi retention sequences having a structure according to the formula KKXX (SEQ ID NO: 515) or the formula KXD/E (where X can be any AA) or comprising the SEQ ID NO: 516 (see Zhan J, et al, Cancer Immunol Immunother 46:55-60, 1998). ER targeting/processing sequences are discussed below.

In AOTI, TS(s) allow a FP to DOS bind target(s) and remain detectably associated with the target or processed by the target (e.g., taken into a cell) under relevant physiological conditions (e.g., at a pH of about 7-8 and a temperature of about 37° C., such as at a temperature of from about 20° C. to about 40° C. (for example, room temperature), and a pH of about 7.5, or other suitable combination of temperature, pH, and other conditions) for a significant period of time (e.g., a period at least about 30 minutes, at least about 45 minutes, at least about 1 hour, at least about 4 hours, at least about 8 hours, or longer such as about 1-12 hours, about 1-24 hours, about 1-36 hours, about 1-48 hours, about 1-72 hours, etc.)). In AOTI, the targeting sequence specifically binds the fusion protein to its target. The concept of specific binding between biomolecules is discussed elsewhere herein.

In AOTI, TS(s) do not exhibit DOS binding of other sequences in the FP, other than the binding of between any multimerization domains of the fusion protein sequence, in which each expressed polypeptide chain of a fusion protein results in a multimeric fusion protein. In some aspects, the fusion protein forms a multimeric peptide. In other aspects, the fusion protein lacks any multimerization domains. Like other constituent sequences, the targeting sequence also typically does not result in a significant or detectable response, or does not result in an initial immune response that is considered clinically significant in view of the therapeutic effect of expressing the fusion protein in the intended species. Also, as with other components of a fusion protein, the targeting sequence(s) of the fusion protein do not detectably or significantly interfere with the functioning of the other components of the fusion protein (e.g., the promoting, induction, or enhancement of an immune response).

In AOTI, a fusion protein can be characterized as being multivalent, multi-specific, with respect to extracellular targets, intracellular targets, or both types of targets, and also or alternatively can be monomeric (single chain) or multimeric (formed from the association of two or more polypeptide chains, typically two or more expression products of a composition of the invention, and, accordingly, having a quaternary structure). Valency refers to the number of binding sequences/regions/domains in a biomolecule and, accordingly, provides an indication of the maximum number of targets/molecules that can be bound by a fusion protein or other molecule (e.g., an antibody). Specificity refers to the ability to specifically bind one or more targets (a bi-specific antibody, for example, exhibits specific binding to two, typically heterologous targets). Such aspects are further discussed below.

In AOTI, a multimeric FP (e.g., a multivalent multimeric fusion protein) exhibits detectably or significantly increased binding for one or more targets than a corresponding monomeric polypeptide. In aspects, a multimeric fusion protein of the invention exhibits detectably or significantly enhanced immunological response, such as more rapid antigen presentation, a more rapid B cell response, a more rapid T cell response, or a combination of any or all thereof (e.g., due to the more rapid processing of larger antigens by APCs).

In AOTI, the immune cell targeting sequence can be characterized as specifically binding to one or more such immune cell receptors (specifically examples of such receptors are provided below). The term "specific binding" or "specifically binds to" or is "specific for" a particular polypeptide can be exhibited by the binding sequence detectably or significantly binding the referenced binding target (e.g., the immune cell receptor) preferentially as compared to any other polypeptides in the environment.

In AOTI, a part of a fusion protein of the invention that binds to a partner will bind that partner with essentially equivalent (+/−15%) of the affinity, avidity, speed, duration, or combination of any or all thereof of one or more wild-type counterpart(s) (most related wild type polypeptide or sequence to the binding sequences). In other aspects, the fusion protein will bind to the partner with a detectably enhanced or significantly enhanced binding affinity, avidity, speed, duration, or combination of any or all thereof, such as an affinity that is at least about 15% greater, at least about 25% greater, at least about 33% greater, at least about 50% greater, or at least about 100% greater (i.e., about 2× in value, such as at least about 2.5× or at least about 3× in value) the affinity, avidity, speed ($K_{on}$), duration ($K_{off}$), or combination of any or all thereof, of one or more corresponding wild-type proteins.

The principles described in this section relating to affinity and binding relationships between sequences can be applied to any other association described herein between sequences and binding partners (e.g., the association of two or more sequences that form a multimeric trap polypeptide expressed by a construct of the invention; the association between an epitope of the invention and an immune cell epitope recognition receptor; the association between a cytokine and a cytokine receptor; etc.). In other words, the affinities described herein can be applied to the binding of other sequences beyond immune cell targeting sequences and immune cell receptors.

In aspects, specific binding further means that the binding sequence does not bind a significant amount of any other polypeptide in the environment. In a particular aspect, specifically binding means that the binding sequence binds the indicated target or targets and does not detectably bind other polypeptides in the relevant environment.

"Binding affinity" generally refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X (e.g., a FP comprising one or more receptor binding sequences) for its partner Y (e.g., a receptor of an immune cell) can generally be represented by the dissociation constant ("Kd"). For example, the Kd can be about 200 nM, 150 nM, 100 nM, 60 nM, 50 nM, 40 nM, 30 nM, 20 nM, 10 nM, 8 nM, 6 nM, 4 nM, 2 nM, 1 nM, or stronger. In aspects, TS(s) or receptor binding domain(s) (RBD(s)) of EP(s) exhibit such levels of affinity for respective targets.

Affinity can be measured by common methods known in the art, including those described herein. Low-affinity relationships mean that binding partners bind slowly and tend to dissociate readily, whereas high-affinity binding relationships mean faster binding and longer association. Association rates (kon) and dissociation rates (koff) are often calculated using a simple one-to-one Langmuir binding model (BIAcore Evaluation Software version 3.2) by simultaneous fitting the association and dissociation sensorgram. The equilibrium dissociation constant (Kd) is calculated as the ratio koff/kon. SFE Chen et al., J. Mol. Biol. 293:865-881 (1999). A variety of methods of measuring binding affinity are known in the art, any of which can be used for purposes of the present invention. Examples of such methods include ELISAs, gel-shift assays, pull-down assays, equilibrium dialysis, analytical ultracentrifugation, SPR, and spectroscopic assays. Related methods and principles adaptable to AOTI are provided in Scatchard et al., Ann. N.Y. Acad. Sci. 51:660, 1949; and U.S. Pat. Nos. 5,283,173 & 5,468,614. Another similar method is isothermal titration calorimetry (ITC), a direct, label-free analytical technique which measures the binding affinity between any 2 interacting molecules (to nanomolar range), such as an immune cell receptor (ICR) and immune cell receptor ligand (ICRL). $K_d$ values can also be measured by, e.g., using surface plasmon resonance assays (e.g., using a BIAcore™-2000 or a BIAcore™-3000 (BIAcore, Inc., Piscataway, N.J.) (e.g., at 25° C. with immobilized target CM5 chips at ~10 response units (RU)).

In AOTI, an "effectively binding" or "specifically biding" relationship also or alternatively can be characterized based on the binding sequence exhibiting a Kd for the target of at least about 200 nM, alternatively at least about 150 nM, alternatively at least about 100 nM, alternatively at least about 60 nM, alternatively at least about 50 nM, alternatively at least about 40 nM, alternatively at least about 30 nM, alternatively at least about 20 nM, alternatively at least about 10 nM, alternatively at least about 8 nM, alternatively at least about 6 nM, alternatively at least about 4 nM, alternatively at least about 2 nM, alternatively at least about 1 nM, or greater. In aspects, TS(s) or RBD(s) of EP(s) exhibit such levels of affinity for their target(s).

In aspects, an "effective binding" or "specifically binding" relationship can also or alternatively means that the referenced molecule binds its partner with a Ka (an equilibrium association constant) of greater than a threshold, such as equal to or greater than about 105 L·mol$^{-1}$ (or "M")$^{-1}$. Ka reflects the speed of association between two molecules and is the inverse of Kd. In AOTI, a fusion protein will exhibit "high affinity" for a target, by exhibiting a Ka of at least about $10^7$ M$^{-1}$, at least about $10^8$ M$^{-1}$, at least about $10^9$ M$^{-1}$, at least $10^{10}$ M$^{-1}$, at least $10^{11}$ M$^{-1}$, at least $10^{12}$ M$^{-1}$, or at least $10^{13}$ M$^{-1}$. constant) for the target antigen.

In still another aspect, an "effective binding" or "specific binding" relationship also or alternatively means that the $K_{off}$ with respect to the fusion protein or other test product and the target is less than about $1×10^{-5}$ s$^{-1}$, such as less than about $5×10^{-4}$ s$^{-1}$, such as less than about $1×10^{-4}$ s$^{-1}$, such as less than about $5×10^{-3}$ s$^{-1}$ or less than about $1×10^{-3}$ s$^{-1}$. In AOTI, the fusion protein binds its target with a $K_{off}$ of from about $1×10^{-4}$ s$^{-1}$ to about $1×10^{-2}$ s$^{-1}$, such as about $1×10^{-4}$ s$^{-1}$ to about $5×10^{-2}$ s$^{-1}$ or about $1×10^{-4}$ s$^{-1}$ to about $1×10^{-3}$ s$^{-1}$. In another aspect "effective binding" or "specific binding" can also or alternatively comprise binding with a $K_{on}$ of more than about 0.01 M$^{-1}$S$^{-1}$, more than about 0.1 M$^{-1}$S$^{-1}$, more than about 1 M$^{-1}$S$^{-1}$, or more than about 5 M$^{-1}$S$^{-1}$. In AOTI, TS(s) or RBD(s) of EP(s) exhibit such affinity characteristics for target(s).

a. Origin/Nature of Targeting Sequences

In one respect, TS(s) of EPs are characterized by origin/homology or in exhibiting relatedness to a sequence of a particular source.

1) Antibody Sequences

In AOTI, FP(s) comprise 1+TS(s) of an Ab against the target compound (partner/target) a variant of such an antibody sequence that is RVRHROSI to one or more antibody sequence(s) that bind to the target.

AOTI relate to CEPESCs expressing Abs or Ab FPs. The description of Ab PPTs/AARSs provided here applies to both aspects of this disclosure except where specifically otherwise stated or clearly indicated by context.

An antibody against a referenced target herein, generally means any suitable type of antibody molecule that specifically binds to one or more portions of the referenced target, under cellular and/or physiological conditions for an amount of time sufficient to allow detection of such binding by suitable means (e.g., ELISA, Western blot, or other similarly suitable protein binding technique described herein and/or known in the art) and, typically, to detectably or significantly promote, induce, or enhance a cellular or physiological effect associated with such binding. The term antibody thus includes any suitable type of immunoglobulin molecule, a fragment of an immunoglobulin (e.g., a fragment that retains a target-binding fragment of an antibody molecule) that specifically binds to a specific target. The concept of specific binding between different binding peptides is discussed elsewhere in this disclosure, but the term as it applies to antibody sequences will also be generally understood by those of ordinary skill in the art.

Antibodies are ORT ITA as "immunoglobulins." The term immunoglobulin generally refers to a class of structurally related proteins consisting of two pairs of polypeptide chains, one pair of light (L) low molecular weight chains and one pair of heavy (H) chains, all four inter-connected by disulfide bonds. The structure of immunoglobulins has been well characterized. SFE FUNDAMENTAL IMMUNOLOGY (Paul, W., ed., 2nd ed. Raven Press, N.Y. (1989)). Briefly, each heavy chain typically is comprised of a heavy chain variable region (abbreviated herein as HCVR or VH) and a heavy chain constant region comprised of three domains, CH1, CH2, and CH3. Each light chain typically is comprised of a light chain variable region (abbreviated herein as LCVR or VL) and a light chain constant region and a single constant region, CL. The VH and VL regions can be further subdivided into regions of hypervariability (or hypervariable regions, which can be hypervariable in sequence and/or form of structurally defined loops), also termed "complementarity determining regions" (CDRs), interspersed with regions that are more conserved, termed framework regions (FRs). In full length, naturally produced antibodies, each VH and VL typically is composed of three CDRs and four FRs, arranged from amino-terminus to carboxy-terminus in the following order: FR1, CDR1, FR2, CDR2, FR3, CDR3, FR4 (which also may be referred to as FR L1, CDR L1, etc. or loop L1, L2, L3 in the light chain variable domain and loop H1, H2, and H3 in the heavy chain domain in the case of hypervariable loop regions (SFE Chothia and Lesk J. Mol. Biol. 196:901-917 (1987)). The term "immunoglobulin" includes natural or artificial mono- or polyvalent antibodies including, but not limited to, polyclonal, monoclonal, multi-specific, human, humanized or chimeric antibodies, anti-idiotypic (anti-Id) antibodies.

The term "antibody," as used herein, refers to immunoglobulin molecules and immunologically active portions of immunoglobulin molecules, i.e., molecules that contain an antigen binding site that immunospecifically binds an antigen. The immunoglobulin ion can be of any type/isoytpe (e.g., IgG, IgE, IgM, IgD, IgA, and IgY), class (e.g., IgG1, IgG2, IgG3, IgG4, IgA1, and IgA2) or subclass of immunoglobulin molecule. Target-binding functions of antibodies can be performed by any number of suitable "fragments" thereof. An antibody fragment can, for example, lack one or both constant domains of an antibody molecule. Examples of typically suitable antibody fragments include (i) a Fab fragment, a monovalent fragment consisting essentially of the VL, VH, CL and CH I domains; (ii) F(ab)2 and F(ab')2 fragments, bivalent fragments comprising two Fab fragments linked by a disulfide bridge at the hinge region; (iii) a Fd fragment consisting essentially of the VH and CH1 domains; (iv) a Fv fragment consisting essentially of the VL and VH domains of a single arm of an antibody, (v) a dAb fragment (Ward et al., (1989) Nature 341:544-546), which consists essentially of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules (known as single chain antibodies or single chain Fv (scFv); see e.g., Bird et al. (1988) Science 242:423-426: and Huston et al. (1988) Proc. Natl. Acad. Sci. USA 85:5879-5883). Antibody molecules also can include diabodies (see e.g., Holliger, P., et al. (1993) Proc. Natl. Acad. Sci. USA 90:6444-6448; Poljak, R. J., et al. (1994) Structure 2:1121-1123). In aspects, antibody molecules can be linear antibodies, which comprise a pair of tandem Fd segments that form a pair of antigen binding regions (such antibodies can be bispecific or monospecific) (SFE Zapata et al. Protein Eng. 8(10):1057-1062 (1995). Any of these antibody "fragment" or antibody derivative molecules also are encompassed within terms such as antibody fragment and should be considered implicitly referenced as a separate aspect of any part of this disclosure that makes reference to the use, expression, or presence of an antibody in a composition or method of the invention, unless otherwise noted or clearly indicated by context (the term "fragment" is not meant to indicate any means of obtaining such an antibody molecule that lacks all of the components of a full length antibody). However, although having similar binding properties as full-length antibodies, such antibody "fragments" collectively and each independently are unique features of the invention, exhibiting different biological and/or physiochemical properties and utilities from full length antibodies. Nonetheless, it should be generally understood that any suitable antibody fragment can be used as a surrogate for an antibody in inventive compositions and methods described herein, and vice versa, unless otherwise stated or clearly contradicted by context. Thus, from the foregoing it should be clear that fusion proteins comprising antibody targeting sequences can comprise antibody "fragments" including either a VL or VH domain or an effective combination of CDRs or even an effective epitope-binding CDR. In some cases, inclusion of substantially all or all of an Ab CDR3, for example, may be sufficient to impart effective target binding to a fusion protein. SFE Zhong G S et al. Oncol Lett. 2013; 5(4):1183-1188 as an example of such a minimized antibody fusion protein.

A number of Ag-binding immunoglobulin molecules and fragments can be used in the inventive methods described herein and/or included in CEPESCs. Non-limiting examples of immunoglobulin molecules that can be EPs or CCCs/ (associative applied compositions (AACs) comprise (a) a complete functional, immunoglobulin molecule comprising: (i) two identical chimeric heavy chains comprising a variable region with a human B cell surface antigen specificity and human constant region and (ii) two identical all human (i.e. non-chimeric) light chains; (b) a complete, functional, immunoglobulin molecule comprising: (i) two identical chimeric heavy chains comprising a variable region as indicated, and a human constant region, and (ii) two identical all non-human (i.e. non-chimeric) light chains; and (c) a monovalent antibody, i.e., a complete, functional immunoglobulin molecule comprising: (i) two identical chimeric heavy chains comprising a variable region as indicated, and a human constant region, and (ii) two different light chains, only one of which has the same specificity as the variable region of the heavy chains. As noted above, Ab molecules also or alternatively include antibody fragments, such as an scFv; a Fab fragment; a Fab' fragment; a F(ab')2 fragment; an Fv molecule; and a disulfide linked Fv molecule.

Methods of antibody production are known in the art and include those described in, e.g., Harlow and Lane: ANTIBODIES; A LABORATORY MANUAL, supra; Harlow and Lane: USING ANTIBODIES: A LABORATORY MANUAL (Cold Spring Harbor Laboratory Press (1999)); U.S. Pat. Nos. 4,376,110; 4,946,778; THE PHARMACOLOGY OF MONOCLONAL ANTIBODIES, vol. 113, Rosenburg and Moore eds. Springer-Verlag, New York, pp. 269-315 (1994), Bird et al. (1988) Science 242:423-426; Huston et al. (1988) Proc. Natl. Acad. Sci. USA 85:5879-5883; & McCafferty et al., Nature (1990) 348:552-554. Monoclonal antibodies (mAbs), for example, may be made using the hybridoma method first described by Kohler et al., Nature, 256:495 (1975), or by other well-known, subsequently-developed methods (SFE Goding, MONOCLONAL ANTIBODIES: PRINCIPLES AND PRACTICE, pp. 59-103 (Academic Press, 1986)). As such, Abs here can refer to Abs against targets that are already known in the art, may be commercially available, or that are generated against a target using such methods.

FPs can comprise any suitable combination of Ab sequences that facilitate binding of referenced target(s). Antibody fusion proteins are known in the art and the principles and strategies applied to such known antibody fusion proteins can be applied to generate antibody fusion proteins comprising one or more gD domains, one or more antigenic sequences, or both, and possibly other components of the fusion proteins discussed herein (e.g., an ITII).

In AOTI, a fusion protein of the invention comprising antibody target binding sequences will result in a single chain fusion protein. Single chain antibody fusion proteins and related techniques and principles applicable to generation of such fusion proteins are exemplified in, e.g., Zaneti A B et al. Front Immunol. 2019; 10:59; Ahmad Z A et al. Clin Dev Immunol. 2012; 2012:980250; De Vlaeminck Y et al. J Control Release. 2019; 299:107-120; Fellermeier S et al. Oncoimmunology. 2016; 5(11):e1238540; Peter K et al. Circulation. 2000; 101(10):1158-1164; US20020018783A1, US20190202931A1, and U.S. Pat. No. 5,990,296. In aspects, a fusion protein comprising antibody targeting sequences will comprise a multimerization domain, typically an antibody multimerization domain, thereby forming a multimeric, often multivalent (e.g., bivalent, trivalent, or tetravalent), and sometimes multi-specific (e.g., bispecific) antibody fusion protein. Examples of multivalent/multimeric antibody fusion proteins and related techniques and principles are described in, e.g., EP2516458, EP3615564A1, WO2011036460A1, WO2019129053A1, US20180216093A1, and Fang F et al. J Antimicrob Chemother. 2004; 53(1):23-25. Additional aspects relating to multivalent/multimeric fusion proteins expressed by constructs of the invention are described below. Additional examples of antibody fusion proteins and related principles and techniques which may be applicable to the design of constructs comprising antibody targeting sequences, multimerization domains, or both are provided in, e.g., US20200115455, US20140023592, US20170210818, US20180201689, US20190298848, US20190225700A1, US20200115455, U.S. Pat. No. 9,102,734, EP3541941A4; Hamilton A A et al. Methods Mol Biol. 1998; 80:427-438; Reisfeld R A et al. Curr Top Microbiol Immunol. 1996; 213 (Pt 3):27-53; Rohrbach P et al. Biotechnol Genet Eng Rev. 2003; 20:137-163; and Antibody Fusion Proteins (1999) S. M. Chamow and A. Ashkenazi, ed., Wiley-Liss (ISBN-10 0-471-18358-X).

Antibodies and other compositions (e.g., antigens, cytokines, adjuvants, vectors, linkers, and the like) described in the references cited in the preceding paragraph also can be considered when considering combination therapy/immunization aspects of the invention and compositions comprising constructs of the invention. This principle also can be applied to other references cited and incorporated herein. More aspects of CCs and combination therapy/immunization methods are described below.

In AOTI, antibody fusion proteins can exhibit one or more DOS "antibody effector functions," such as C1q binding; complement dependent cytotoxicity; Fc receptor binding; Ab-dependent cell-mediated cytotoxicity (ADCC); detectably inducing/enhancing phagocytosis, down regulation of cell surface receptors (e.g., B cell receptor (BCR); cross-presentation of antigens by antigen presenting cells/dendritic cells; or a combination of any or all thereof. In AOTI, an antibody targeting sequence fusion protein will exhibit two or more of such functions. In other aspects, a fusion protein comprising one or more antibody targeting sequence will exhibit no effector functions.

2) Non-Antibody Ligand Sequences

In aspects, FPs comprise one or more targeting sequences that are non-antibody sequences, having no identity or substantial identity to any known epitope binding antibody sequences for the target or, in some aspects, for any target. In AOTI, fusion proteins of the invention lack any antibody targeting sequences other than CDR and FR sequences. In AOTI, a fusion protein of the invention lacks any antibody targeting sequences. In AOTI, a fusion protein of the invention lacks any antibody sequence (e.g., comprises no sequence of more than about 50 amino acid residues, more than about 35 amino acid residues, or even more than about 25 amino acid residues exhibiting substantial identity to an antibody sequence).

A fusion protein expressed by a construct of the invention can comprise any suitable number of ligand/receptor sequences. In AOTI, a fusion protein comprises only a single extracellular targeting domain (e.g., a gD receptor-binding domain that binds to a single gD receptor in a target species, such as Nectin-1). In other aspects, a fusion protein can comprise one or more sequences that bind to two or more extracellular targets, such as a single gD sequence that binds to multiple receptors (e.g., HVEM and Nectin-1) or two heterologous sequences that target different receptors (e.g., a DEC-205-binding keratin sequence and a HVEM-binding gD sequence). In any such case, such a fusion protein can also comprise one or more intracellular targeting domains (e.g., a PTPS, an ERTPS, or both).

Non-antibody targeting sequences can comprise any portion of a polypeptide that specifically binds to a target. Binding sites from a receptor-ligand pair are non-limiting examples of domains that, in a manner akin to an antibody-epitope interaction, may be used as targeting sequences, similar to how in aspects of the invention a receptor-binding gD domain may be incorporated to bind a gD polypeptide to a gD receptor (e.g., Nectin-1). Further exemplary non-antibody targeting sequences include antibody mimetics, such as polypeptide scaffolds that mimic the structure of an antibody.

FPs can comprise any suitable ligand binding domain, any suitable receptor binding domain, or a combination thereof, which act/acts as a targeting sequence in the fusion protein. A ligand binding domain is a portion of a receptor molecule that specifically binds to a site on a ligand. A receptor binding domain is a portion of a ligand molecule that specifically binds to a site on a receptor. By way of example, tumor necrosis factor alpha is a ligand that binds to and signals via tumor necrosis factor alpha receptor. Thus, for example, a fusion protein comprising a portion of TNFalpha that specifically binds to TNFalpha receptor could be used as a targeting sequence to direct a fusion protein to cells expressing the TNFalpha receptor.

In aspects, TS(s) may comprise ligands that are, for example, receptor-binding sequences of hormones, growth and/or survival factors, structural proteins, enzymes, cytokines, transport proteins, transmembrane proteins, nuclear proteins, proteins which bind other biomolecules, and/or binding domains derived from these proteins (such as fragments, variants, and variants of fragments thereof that are at least related to a naturally occurring ligand). In AOTI, the targeting domain comprises a sequence that is a ligand for a receptor of a cell of the immune system. In AOTI, the targeting domain is a ligand for a cell of the innate immune system (e.g., a macrophage), the innate trained immune system (e.g., an NK cell or dendritic cell), or the trained/adaptive immune system (e.g., a T cell). Targeting sequences can comprise at least a ligand binding fragment of, e.g., a T lymphocyte immunoreceptor, T cell inhibitory receptor (TCIR), T-cell co-inhibitory molecule, T-cell co-stimulatory molecule, B lymphocyte receptor, DC receptor, NK cell receptor, cytokine receptor, growth factor receptor, chemokine receptor, or tumor cell receptor. Targeting sequences also or alternatively can comprise sequences that effectively bind to a component of a tumor cell, tumor microenvironment, tumor associated growth factor or receptor, tumor associated cytokine or receptor, tumor associated T lymphocyte, T cell co-stimulatory or inhibitory molecule, immune cell, pathogen, or pathogen-associated cell. Specific examples of ligand and receptor sequences that can be used as targeting sequences include, e.g., binding sequences for binding or binding sequences of cytotoxic T lymphocyte associated antigen-4 (CTLA-4, CD 152), Programmed Death-1 protein (PD-1), Programmed death ligand-1 ("PD-L1" or "PDL-1"), Programmed death ligand (PD-L2 or PDL-2), B7-H3 (CD276), T-cell immunoglobulin and mucin-domain containing-3 (TEVI-3), Carcinoembryonic antigen-related cell adhesion molecule 1 (CEACAM-1), Carcinoembryonic Antigen (CEA), V domain Ig suppressor of T cell activation (VISTA), V-set and immunoglobulin domain containing 8 (VSIG8), B and T lymphocyte attenuator (BTLA), Herpesvirus Entry Mediator (HVEM), CD 160, T cell Ig and ITM domain (TIGIT), CD226, CD96, Lymphocyte activation gene-3 (LAG-3), transforming growth factor β (TGF-β), transforming growth factor β receptor (TGFpR), Receptor Activator of Nuclear Factor κB (RANK), RANK ligand (RANKL), 4-IBB (CD137), Inducible T-Cell Costimulator (ICOS), OX-40 (CD134), glucocorticoid-induced TNFR-related protein (GITR), CD27, IL6R, IL23R, IL17R, IL-6, IL-23, IL-17, CD39, CD40, CD40L, CD47, CD73, CCR4, CCR5, CXCR4, IL12R, CD4, IL-2R, CD25, CD3, gp120, NKG2D, Epidermal growth factor receptor (EGFR, EGFR1, ErbB-1, HER1), ErbB-2 (HER2/neu), ErbB-3/HER3, ErbB-4/HER4, Epidermal growth factor (EGF), Transforming growth factor a (TGFa), Vascular endothelial growth factor (VEGF), Vascular endothelial growth factor receptor-1 (VEGFR-1), VEGFR-2 or VEGFR-3, transforming growth factor β receptor II (TGFpRII), programmed death 1 protein (PD-1), T cell immunoglobulin and mucin domain containing 3 (TEVI-3), B- and T-lymphocyte attenuator (BTLA), CD 160, CD226, T cell Ig and ITM domain (TIGIT), CD96, CD44, Colony stimulating factor 1 receptor (CSF1R), CCR4, Killer-cell immunoglobulin-like receptor (KIR), Vascular endothelial growth factor receptor (VEGFR), Receptor Activator of Nuclear Factor κB (RANK), V-set and immunoglobulin domain containing 8 (VSIG8), LIGHT (TNFSF14), Leukocyte Associated Immunoglobulin-like Receptor 1 (LAIRI), or V domain Ig suppressor of T cell activation (VISTA).

3) Multimeric Fusion Protein Products

In AOTI, FPs comprise one or more multimerization domains and will be or will ultimately form a multimeric protein after expression. Multimeric fusion proteins will typically exhibit binding preference for other expression products of the constructs of a composition as compared to other endogenous proteins, except in some aspects for targets bound by targeting sequences where the targeting sequence is operable in a single chain expression product. In some aspects, the multimeric protein will be multivalent (comprising two or more binding domains), and possibly multi-specific, binding to two or more different targets, typically with different binding properties (e.g., affinities). In aspects, such a multimeric PPT binds a single type of target or single target. In aspects, such a multimeric PPT is multivalent, comprising at least two domains that contribute to the binding of the single type of target or single target.

A "multimerization domain" is a sequence/domain that preferentially interacts or associates with another polypeptide molecule or region, directly or indirectly, wherein the interaction of multimerization domains substantially contribute to or efficiently promote multimerization (i.e., the formation of a dimer, trimer, tetramer, or higher order multimers, which may be a homodimer, heterodimer, homotrimer, heterotrimer, homomultimer, heteromultimer, or the like). Multimeric PPT EPs may be multi-specific, if they bind to more than one target (e.g., DEC-205 and HVEM). Multimeric fusion proteins also or alternatively can be multivalent, comprising two, three, four, or more binding domains for one, two, three or more extracellular targets, intracellular targets, or a combination thereof.

Multimerization may be due to, ia, one or more types of molecular forces, including covalent bonds (e.g., disulfide bonds or bridges), ionic bonds, metallic bonds, electrostatic interactions, salt bridges, dipole-dipole forces, hydrogen bonding, Van der Waals forces, hydrophobic interactions, or any combination thereof. A multimeric FP typically is stable under appropriate conditions (e.g., physiological conditions, in an aqueous solution suitable for expressing, purifying, or storing recombinant or engineered proteins, or under conditions for non-denaturing or non-reducing electrophoresis).

A multimeric FP can comprise any suitable type of multimerization. Exemplary multimerization domains comprise 1+ disulfide bonds, zinc finger motif, a leucine zipper motif, helix-turn-helix, helix-loop-helix, or CT. In AOTI, a multimeric protein is formed by ia ≥1 cysteine-cysteine disulfide bonds.

Multimerization means the association of at least two multimerization units and more typically three, four, five or six such units via association of a homomultimerizing peptide. In AOTI, multimers comprise at least two initially separate polypeptide chains that form multimers after initial expression. Single chain multimeric peptides also can form through intra-chain domain:domain interactions, such as in some single chain antibody sequence fusion proteins (described above). A multimerization domain can be for example, a dimerizing, a trimerizing, a tetramerizing or a pentamerizing multimerization domain. In AOTI, multimers are connected without any intervening amino acids. In aspects, a multimer comprises a linker sequence, such as a linker sequence of about 1 to about 250, or about 1 to about 100, or about 1 to about 50, about 1 to about 25, about 1 to about 15, about 1 to about 10, or about 1 to about 5 amino acids Linker sequences are described elsewhere herein. Thus, in some cases, the fusion protein is provided that comprises at least two polypeptide chains expressed from constructs of the invention. In some cases, the two PPT chains are covalently linked to one another, e.g., via a disulfide bond. In other instances, the two PPT chains are not covalently linked to one another.

A multimeric FP typically will comprise at least one suitable multimerization domain. If multiple multimerization domains are present in a fusion protein or fusion protein component, the domains need not be identical to one another. The multimerization domains can function either to effect homomultimerization or heteromultimerization, and can contribute to noncovalent or covalent association of the individual subunits.

In aspects, a multi-chain, multimeric fusion protein final product is achieved from the expression of an initial single chain fusion protein comprising two or more multimerization domains that lead to multimer formation and at least one cleavage site, such as a 2A cleavage site, which cleavage site can be optionally located in a linker, and which cleavage site ultimately results in the cleavage of the initially expressed polypeptide chain, at some of the fragments of which can assemble into multi-chain, multimeric fusion proteins. As noted by the preceding sentence, in practice not all fusion protein expression products may exhibit the full theoretical potential valency, specificity, or level of multimeric interaction. Thus, for example, a collection of FPs expressed from a NAM composition of the invention can comprise a mixture of monomers, dimers, trimers, and tetramers, etc.

Antibody Multimerization Domains

In AOTI, a fusion protein of the invention comprises one or more antibody multimerization domains. Immunoglobulin molecules naturally are multimeric, multivalent molecules, with disulfide bonds joining each CH1 domain to one CL domain, and CH2 domains to one another. Antibody dimerization domains that can be incorporated into fusion proteins of the invention can be selected from, e.g., an IgE heavy-chain domain 2 (EHD2), an IgM heavy-chain domain 2 (MHD2), an IgG heavy-chain domain 3, an IgA heavy-chain domain 3, an IgD heavy-chain domain 3, an IgE heavy-chain domain 4, an IgM heavy-chain domain 4, an Fc domain, an uteroglobin dimerization domain, and functional variants of any one of the foregoing.

A number of approaches to developing multimeric proteins from antibody multimerization domains are known in the art which can be applied to generating multimeric fusion proteins of the invention. For example, antibody Fc domains can be multimerised into multivalent forms by engineering the presence of a cysteine residue at position 309 to form multimers (SFE PCT/EP2015/058338), including dimer, trimer, tetramer, pentamer, and higher than pentamer forms. Miller et al. (J. Immunol., 170:4854-4861, 2003) describes tetravalent IgG antibodies and Rossi et al. (Cancer Res., 68:8384-8392, 2008) describes construction of a hexavalent IgG antibody (composed of six Fab and two Fc regions) using the so-called "Dock-and-Lock" method. Similarly, a "knobs and holes" system can be used to generate antibody sequence multimeric proteins (see Xie, et al. 2005 J Immunol Methods 296: 95). Hinge/Cn3 multimerization domains and reference sequences are described in WO 2004/076489, US20130171140 and US20140234316. Multimerization through CH2 and CH3 domains of IgG derived proteins is described in, e.g., Soleimanpour et al, 2015, Appl Microbiol Biotechnol). Fab-fragment multimerization approaches are described in, e.g., Mayer et al, 2015, Int J Mol Sci). Several references describe the use of antibody Fc regions to form multimeric proteins. Any suitable one of these methods can be employed to generate multimeric fusion proteins of the invention. Additional principles, compounds, and techniques are described in, e.g., AU2017200515A1, U.S. Pat. No. 9,802,995, US20180362653A1, US20170210802A1, Dal Porto et al., Proc. Natl. Acad. Sci. USA 90:6671-6675 (1993); Greten et al., Proc. Natl. Acad. Sci. USA 95:7568-7573 (1998); Hamad et al., J. Exp. Med. 188:1633-1640 (1998); Schneck et al., U.S. Pat. Nos. 6,015,884, 6,140,113, US20050079170A1, US20140155581A1, US20190276511A1, US20190381184A1, US20180044404A1, EP3027657A1, WO 2008/151088, U.S. Pat. No. 9,212,231, US20200140547A1, and US20130156765A1. Techniques and compositions from these disclosures can also or alternatively be used to develop multimeric antibody FPs and additional examples of multimeric, multivalent, and multi-specific antibody domains and fusion proteins are also DEH.

Non-Immunoglobuin Interaction Domains

In some aspects, the multimerization (or "interaction") domains/sequences of a multimeric fusion protein of the invention comprise, primarily comprise, generally consist of, or consist of non-antibody (non-immunoglobulin) domains. Thus, In AOTI, the invention provides constructs that express multimeric fusion proteins that lack any antibody multimerization domains or that even lack any antibody sequences.

Interaction domains may correspond to or be derived from proteins that dimerize or multimerize, e.g., through non-covalent bonds and/or disulfide bonds, to form the quaternary structure of a protein. In some aspects, the interaction domains of polypeptides expressed from constructs of the invention may be identical, so that homodimers are formed. In other aspects, the interaction domain monomers may be different, resulting in formation of heterodimers. Dimerization motifs from specialized proteins may be used. Exemplary, non-limiting proteins containing dimerization motifs include but are not limited to receptor tyrosine kinases, transcription factors such as leucine zipper motif proteins and nuclear receptors, 14-3-3 proteins, G-protein coupled receptors, kinesin, triosephophateisomerase, alcohol dehydrogenase, Factor XI, Factor XIII, Toll-like receptor, fibrinogen, coil-coil homodimerization motifs such as Geminin, HIV major homology region, S. cerevisiae Sir4p, zinc-finger domains, viral coat proteins, and p53.

A well-studied type of non-antibody peptide with homodimerizing ability are leucine zipper proteins, which is a common three-dimensional structural motif in several proteins. These motifs are usually found as part of a DNA-binding domain in various transcription factors. A typical single leucine zipper includes multiple leucine residues at approximately 7-residue intervals, which forms an amphipathic alpha helix with a hydrophobic region running along one side. Examples of leucine zipper sequences include SEQ ID NOs:517-526. Another example of such a domain is the leucine zipper domain of AP-1. In some cases, FPs comprise two leucine zipper polypeptides that bind to one another. Use of leucine zipper sequences to form multimeric proteins is KITA.

FPs can alternatively comprise a dimerization domain of the collectin family (e.g., ACRP30 or ACRP30-like proteins) which contain collagen domains consisting of collagen repeats Gly-Xaa-Xaa. A collagen domain can comprise (Gly-Xaa-Xaa)n, where Xaa is any amino acid, and where n is an integer from 10 to 40. In some cases, a collagen domain comprises (Gly-Xaa-Pro)n, where Xaa is any amino acid and n is an integer from 10 to 40. Such dimerization domains are KITA; SFE US2003/0138440. In aspects, multimerization domains comprise a collagen oligomerization sequence, e.g., SEQ ID NO:527. An exemplary trimerization domain is a human cartilage matrix protein trimerization domain. Other dimerization peptides include coiled-coil domains, such as SEQ ID NOs: 528-532.

Fibronectin multimerization domains are also KITA and can generate multimeric FPs (SFE US20130079280). Another known peptide with trimerizing ability is tetranectin (e.g., Swis Prot. P05452). TNF superfamily family proteins, such as human TNF (Swiss Prot P01375), human CD40 ligand (P29965), and OX40-L (P23510) are known to form trimers. Recombinant proteins comprising such domains are described in US20190016771. An example of such a TNF multimerization sequence is SEQ ID NO:533.

Examples of tetramerizing peptides for making tetrameric fusion proteins include tetrabrachion (Stetefeld et al., Naure Struc. Biol. 7:772-776, 2000), modified GCN4 leucine zipper (Harbury et al., Science 262:1401-1407, 1993), and Sendai virus phosphoprotein (Tarbouriech et al., Nature Struc. Biol. 7:777-781, 2000). Pentemeric fusion proteins can comprise multimerization domains from a pentamerizing peptide, for example, Trp-zipper protein (also called Trp-14; Liu et al., Proc. Natl. Acad. Sci. USA 101:16156-16161. 2004), or cartilage oligomeric matrix protein (COMP; Malashkevich et al., Science 274: 761-765, 1996). For forming hexameric fusion proteins, a multimerization domain of a hexamerizing peptide, such as CC-Hex (Zaccai et al., Nature Chem. Biol. 7:935-941, 2011) can be incorporated into the fusion protein. Tetramers can also be formed from multimerization domains of a streptavidin tetramer protein (SFE U.S. Pat. No. 5,635,363). Pentamers can also be formed from by incorporation of a self-assembling coiled-coil domain (SFE US2004209295).

Additional examples of multimerization proteins from which multimerization domains can be obtained include eukaryotic GNC4 transcription factor motifs; bacterial barnase/barstar module multimerization domains; VLRB protein multimerization domains, such as from lamprey or hagfish, (which can in some cases form octamers or decamers) (SFE US20190016760A1); multimerization domains of a foldon protein; heptamer-forming C4 bp oligomerization domains; and DsRed tetramerization domains (SFE Gross et al., Proc. Natl. Acad. Sci. USA 97:11990-11995 (2000); Wall et al., Nature Structural Biol. 7:1133-1138 (2000), and U.S. Pat. No. 7,202,349).

Additional examples of multimerization systems are described, for example, in WO2001049866, US2003013844, US20100168390, U.S. Pat. No. 7,482,430, Meier et al., J Mol Biol. (2004) 344(4): 1051-69 & Kabanova et al, PNAS (2014) 111(5): 17965-17970; Jones (Genome Biol. 5:226, 2004); Woolfson (Adv. Protein Chem. 70:79-112, 2005); Parry et al. (J. Struc. Biol. 163:258-69, 2008); Zaccai et al. (Nat. Chem. Biol. 7:935-941, 2011); Ivarsson (FEBS Lett. 586:2638-2647, 2012); WO2019048936; WO2019051094; US20190315817; US20180303931; WO2019086394; WO2018151820; and WO2017074235.

"Trap" Multimeric Fusion Proteins

Another class of multimeric proteins are "trap" proteins. A "trap" in TD refers to an (1) expression product that (2) binds and detectably or significantly modulates the biological activity of a single target molecule (e.g., through target-mediated cellular uptake of the fusion protein, downstream signaling, and the like), which target molecule typically is an extracellular molecule, such as a cell receptor (e.g., an immune cell receptor), (3) comprises two or more identical or substantially identical (typically identical) polypeptide chains, each of which chain contains (a) a target binding sequence, (b) an optional but typically present flexible linker, and (c) a multimerization domain that is smaller than a full antibody multimerization domain, subject to less processing than a full antibody multimerization domain, or both, and which typically lacks any antibody multimerization sequences. For example, trap proteins lack Fc portions and do not exhibit effector functions. Compared to full-length Abs, trap proteins typically exhibit detectably better penetration of cells & microenvironments (cells & surrounding milieu material). As a trap protein is composed of identical monomers it is multivalent but monospecific.

In AOTI, the trap protein comprises a non-antibody sequence multimerization domain. In AOTI, the trap is a trimeric protein comprising a stable trimerization domain. An example of a suitable domain for formation of a trap protein is the trimerization domain from human CMP-1. Incorporation of a CMP-1 multimerization sequence results in a parallel, disulfide-linked, and rod-shaped trimeric structure with high stability following expression. The trap monomers can self-assemble into the final form of the multimeric trap protein in vivo, including in mammals. Other multimerization domains that exhibit similar stability and functioning can alternatively be used to form a trap protein, including variants of CMP-1 multimerization domains.

The target binding domain of a trap protein can comprise antibody sequences, such as immunoglobulin VH domain, immunoglobulin VL domain, a VH and VL fusion protein, scFv, a PPT derived from a binding and/or framework region of an Ab. The target binding domain also can be a non-immunoglobulin target-binding domain, such as a single domain Ab mimic based on a non-immunoglobulin scaffold (such as an FN domain-based monobody, Z domain-based affibody, DARPINs), singly and in any combination.

Sequences encoding a variety of multimeric trap proteins are described in this disclosure for incorporation into compositions of the invention. One example of a trap expressed by constructs of the invention is a DEC-205 binding trap, which can be a trimeric trap comprising, e.g., a CMP-1 trimerization domain, such as a murine or human CMP-1 trimerization domain, and anti-DEC-205 antibody receptor epitope binding sequences or DEC-205 ligand sequences, such as keratin sequences discussed elsewhere herein. In aspects, a trap comprising a CI AARS, such as a PD-L1 or PD-1 sequence is expressed from the nucleic acid sequences of a composition.

Trap proteins exhibit detectably or significantly greater binding for targets than their constituent monomers, enhanced stability as compared to constituent monomers, or both. In AOTI, the trap exhibits at least about 20×, at least about 50×, at least about 100×, at least about 200×, or at least about 500× affinity for the target than its monomeric components. The trap construct does not significantly or detectably enhance the immunogenicity of the fusion protein or impair the functionality of the sequences contained in each chain. Each chain of such a trap can comprise, e.g., one or more antigenic sequences that are taken up by a target cell upon target receptor binding, as well as other components (e.g., one or more intracellular targeting sequences such as one or more PTPSs, ERTPSs, or a combination thereof). Exemplary trap proteins are described in Song W et al. Nat Commun. 2018; 9(1):2237.

Trap proteins that modulate targets can be classified as inhibitory traps or stimulatory traps. Inhibitory traps for macromolecule targets include traps that can be protein molecules that specifically bind and further inhibit or block the biological functions of a target of interest, such as an interleukin, TNF-alpha (and TNF-alpha receptor), TGF-beta (and TGF-beta receptor), CSF-1 (and CSF-1 receptor), CXCR proteins and ligands, CCR proteins and ligands, ACKR3 and its ligands (CCL11, CCL12), ACKR6 and its ligand (CCL18), CTLA-4, PD-1, PD-1, PD-L2, B7-H3 (CD276), B7-H4 (VTCN1), HVEM (CD270 or TNFRSF14), BTLA (CD272), TIM-3, GALS, TIGIT, A2aR, LAG-3, KIRs and MHC class I or II. Traps can also be stimulatory, including those that agonistically act on immune checkpoint targets such as CD28, ICOS (CD278), 4-1BB (CD137 or TNFRSF9), OX40 (CD134 or TNFRSF4), GITR (CD357 or TNFRSF18), CD27 (TNFRSF7), and CD40 (TNFRSF5) or that mimic the agonistic effects of the ligands of the above receptors, including but not limited to B7.1 (CD80), B7.2 (CD86), B7-H5 (VISTA or Gi24), ICOSL (B7H2 or CD275), 4-1BBL (CD137L), OX40L (CD252), GITRL, CD27L (CD70), and CD40L (CD154). Targets for agonistic traps also include some toll-like receptors, including TLR4, TLR7, TLR8, & TLR9. Such trap proteins are described in US20190381184.

In AOTI, the invention provides fusion proteins comprising a trap protein in which one or more antigens, such as two or more antigens, such as three or more antigens, are inserted within a multimerization domain, such as a trimerization domain (and constructs encoding such fusion proteins). In AOTI, such antigens are bound to each other, the parts of the associated multimerization, or both, by linker sequences, such as those described elsewhere herein. In AOTI, some, most, generally all, or all of such antigen sequences are associated with one or more intracellular targeting sequences, such as one or more PTPSs. Such FPs can target a DCR, such as DEC-205, and comprise a multimerization domain, e.g., a CMP-1 multimerization domain.

b. Intracellular Targets and Targeting Sequences

TS(s) can target one or more intracellular targets, such as an organelle-associated target or a target that is an intracellularly expressed polypeptide or other biomolecule. Examples of such ITS(s) are described in detail here, but also may be referred to in other portions of this disclosure.

In one exemplary aspect, a fusion protein comprises one or more phagosome targeting sequences. In one such aspect, the inclusion of the phagosome targeting sequence results in enhanced antigen-specific immune responses to one or more antigens included in the fusion protein or co-expressed with the phagosome-targeting sequence fusion protein. Phagosome targeting sequences have been described in the art (SFE Pereira M P et al. ACS Infect Dis. 2015; 1(12):586-592) and include cathepsin fragments, γ-Secretase-targeting sequences (or sequences targeting related peptides CD44 or LRP), Rab39-binding sequences, and the like. Relevant principles and techniques are also discussed in, e.g., Pauwels A M, et al. Trends Immunol. 2017; 38(6):407-422.

An intracellular targeting/localization and processing sequence also or alternatively can be a sequence that enables an associated fusion protein to avoid, disrupt, or overcome processing by one or more organelles. For example, a fusion protein of the invention can comprise one or more lysosomal or phagosomal avoidance/disruption sequences. Such sequences can be obtained from adenovirus penton proteins, influenza virus HA-2, and the like (SFE US20020155609A1; Bal et al., Eur J Biochem 267:6074-81 (2000); and Wagner, et al., Proc. Natl. Acad. Sci. USA, 89:7934-7938, 1992). In aspects, a fusion protein also or alternatively comprises a sequence targeting an exosome. Examples of exosome targeting sequences, e.g., the N terminus of lysosomal associated membrane protein 2b (Lamp2b), are also known in the art (SFE Hung M E et al. J Biol Chem. 2015; 290(13):8166-8172 and Tian Y et al. Biomaterials. 2014; 35(7):2383-2390 and the C1C2 domain from MFG-E8. Additional exosome TSs that may be useful in the context of such FPs are described in, e.g., WO2020081786 and WO2015002956.

In AOTI, a fusion protein expressed by a construct of the invention also or alternatively comprises an intracellular TS, extracellular TS, or both, which detectably or significantly promotes processing of the fusion protein by early endosomes (e.g., by incorporation of CD40-specific monoclonal antibody sequences). In AOTI, a composition of the invention also or alternatively comprises an intracellular TS, extracellular TS, or both, which detectably or significantly targets late endosomes, early lysosomes, or both (e.g., a DEC205-specific sequence). In AOTI, a composition of the invention comprises sequences encoding both types of such fusion proteins. In AOTI, such different fusion proteins are encoded by sequences on different NAMs. In AOTI, a method is provided in which such different NAMs are administered in association with each other (e.g., in a sequential administration method). In AOTI, one of such types of fusion proteins comprises one or more gD sequences, one or more antigens, or both, or both of such types of fusion proteins comprise one or more gD sequences, antigenic sequences, or both.

1) Proteasome Targeting/Processing Sequences (PTPSs)

In AOTI, the constructs of the invention encode and fusion proteins encoded by such constructs comprise one or more proteasome targeting/processing sequences ("PTPSs"). Numerous suitable proteasome targeting/processing sequences are KITA and, in general, any suitable number of any suitable type of PTPSs can be incorporated into EPs.

A PTPS can target any suitable type of proteasome or two or more types of proteasomes (e.g., a classical proteasome, an immunoproteasome, or a thymo-proteasome) (SFE Rock K L. Trends Immunol. 2016; 37(11):724-737 and Sijts E J et al. Cell Mol Life Sci. 2011; 68(9):1491-1502) and any suitable portion/assembly/aspect of a proteasome or proteasomal system (e.g., a 26S proteasome, 20S proteasome/chamber, a 30S proteasome, or hybrid proteasome, or further subunits such as a base subcomplex, a 19S core, or an RP complex) (SFE Tanaka K. Proc Jpn Acad Ser B Phys Biol Sci. 2009; 85(1):12-36, with respect to the biology and composition of proteasomes). In AOTI, FPs comprise PTPS(s) that target an immunoproteasome (optionally in combination with a standard proteasome targeted by the same PTPS or another PTPS contained in the fusion protein). In an exemplary aspect, at least one PTPS of a fusion protein binds to one or more subunits of an immunoproteasome, such as β1i, β2i, or β5i. In aspects, at least one PTPS of a fusion protein also or alternatively detectably or significantly binds to a thymo-proteasome or a subunit thereof (e.g., β1i, β2i, or β5t).

In AOTI, a fusion protein or polypeptide of the invention comprises a proteasome targeting chaperon sequence. One example of such a type of sequence is a calreticulin sequence. Calreticulin peptides and sequences are described in, e.g., U.S. Pat. No. 9,085,638 and the use of such sequences for proteasome targeting is discussed in, e.g., US Patent Publication 20190177733. Calreticulin sequences also can in some contexts and aspects also or alternatively promote DC uptake of fusion proteins, MHC I molecule association of antigens, induces immune cell cytokine production, promotes TH cell activity, and provides an "eat me" signal to DCs and other innate trained immunity cells and innate immunity cells. SFE Cheng W F, et al. J Clin Invest 2001; 108:669-678; Gardai et al. Cell 123: 321-334, 2005). As such, constructs comprising one or more calreticulin-encoding sequences, such as a functional fragment of a naturally occurring calreticulin or a functional variant of a naturally occurring calreticulin that is at least highly related or substantially identical to a wild-type calreticulin, are another aspect of the invention. In AOTI, such a construct further comprises ≥1 other types of PTPSs, e.g., 1+ ubiquitin sequences.

In aspects, a PTPS is a proteolytic signal or motif that targets an associated polypeptide for processing in the proteasome. Accordingly, fusion proteins of the invention can comprise one or more of such PTPSs or one or more of such PTPSs in combination with other PTPSs, such as a ubiquitin sequence. One such motif, the PEST sequence, is found extensively in short-lived proteins (Rogers et al Science. 234(4774):364-8 1986). A PEST sequence is a peptide sequence that is rich in proline (P), glutamic acid (E), serine (S), and threonine (T). This sequence is associated with proteins that have a short intracellular half-life. For example, Mouse Ornithine DeCarboxylase (MODC) is one of the shortest half-lived proteins in mammals due to the inclusion of PEST sequences in its carboxy terminus (Loetscher et al. J Biol. Chem. 1991 Jun. 15; 266(17):11213-20; Ghoda et a\Mol Cell Biol. 1992 ay; 12(5):2178-85). Proteomics). Predicted PEST sequences have been identified in well-known antigens including E1A (residues 44 to 49, 125-149, 177-202, 223-244), c-myc (10-51, 52-65, 83-126, 168-206, 206-241, 241-269, 276-287), p53 (39-62, 62-98, 213-232), c-Fos (31-91, 128-139, 205-250, 265-279, 307-358, 360-380), v-Myb (4-16, 174-186), p730 (323-361), HSP70 (33-46, 125-152, 424-445), HMG-CoA reductase (381-395, 429-442, 442-456), TAT (382-395), alpha-casein (58-79, 151-193), beta-casein (−1-25, 113-134) (Rogers et al. Science, 1986. vol. 234 pp 364-368). SFE Rogers S, Wells R, Rechsteiner M. Amino acid sequences common to rapidly degraded proteins: the PEST hypothesis. Science. 1986; 234(4774):364-368 and WO2004066935. Known PEST sequences include, e.g., SEQ ID NO:534. Additional PEST sequences and related PMCs are described in Doody K M et al. Cell Res. 2014; 24(9):1027-1028; Belizario J E et al. Curr Protein Pept Sci. 2008; 9(3):210-220; and Joshi S N et al. MAbs. 2012; 4(6):686-693. PEST motifs are also classified as "degrons," which are DFEH.

In AOTI, a fusion protein of the invention can also or alternatively comprise one or more proteasomal cleavage sites (sites that are cleaved by proteasomal processing at detectable or significant levels). Such sites and the identification of such sites are described in, e.g., Liu T et al. Cell Mol Immunol. 2009; 6(2):135-142.

In aspects, FPs can comprise ≥1 PTPS(s) that comprise sequences from or that are highly similar to one or more "ubiquitin like proteins" Numerous ubiquitin-like proteins are KITA and further examples of such proteins are DEH. An example of such a protein is FAT10. FAT10 FPs are rapidly degraded by the proteasome at potencies/speeds comparable with ubiquitin. SFE Mark Steffen et al. Molecular and Cellular Biology April 2005, 25 (9) 3483-3491.

In some aspects, a fusion protein comprising a PTPS also will comprise one or more protease cleavage site recognized by proteases that may be present in the expression environment. In AOTI, such cleavage sites are cleavage sites recognized by a metalloprotease (MMP), a sequence recognized by urokinase uPA, or a sequence recognized by furin, or the fusion protein comprises a combination of such cleavage sites.

In AOTI, inclusion of one or more PTPSs in EPs detectably or significantly enhances proteasomal processing of the associated FP. In AOTI, the inclusion of 1+ PTPSs in FPs AOA DOS enhances one or more aspects of immune response associated with the administration and expression of the construct, such as one or more MHC I or MHC II responses.

(a) Ubiquitin and UBL PTPSs

In AOTI, PTPSs of FP(s) comprise, PC, GCO, or consist of 1+ ubiquitin sequences. FPs can comprise any suitable number of ubiquitin sequences. In AOTI, the fusion protein comprises only a single ubiquitin sequence. In AOTI, the fusion protein comprises only one PTPS. In one aspect a fusion protein comprises only one PTPS and that one PTPS is a ubiquitin (Ub) sequence. In AOTI, PTPS(s) comprise polyubiquitin (polyUb) sequence(s).

In AOTI, the PTPS comprises a Ub sequence that comprises both a recognition element and a Ub attachment site. In natural systems, polyubiquitin (polyUb) chains are created by adding Ubs to a single Ub (at a UB attachment site) attached to a target protein (via a Ub attachment site). PolyUb chains consisting of Lys48-Gly76-linked subunits are the principal signal for proteasome-mediated proteolysis. Chains of four or more Ubs are believed to be capable to bind to the 19S regulatory subunits of 26S proteasomes with sufficient avidity to enable the 19S subunit to unfold the attached substrate and thread it into the interior of 20S proteasomes, where the substrate is cleaved into oligopeptides. Thus, In AOTI, the invention provides fusion proteins and related constructs comprising four or more Ubs, such as five or more Ubs, six or more Ubs, or seven or more Ubs. In aspects, however, the invention alternatively provides fusion proteins comprising less than four full Ubs, but which still exhibit detectable or significant proteasomal targeting and other polyUb functionalities. Thus, In AOTI, the invention provides fusion proteins comprising three or more Ubs, and in another aspect the invention provides fusion proteins comprising less than 4 Ubs, such as 2-3 Ubs. In AOTI, CEPESCs encode FPs comprising 1+ partial Ubs that still impart polyUb functionality when combined with other Ubs. E.g., FPs can comprise 1, 2, or 3 partial Ubs in combination with 2, 3, 4, or 5 Ubs, such as 1 partial Ub in combination with 3 complete, generally complete, or essentially complete Ubs.

Cleaved peptides disassociated from polyUbs in normal cellular functions are believed to be the principal source of peptides for class I molecules of the major histocompatibility complex. As such, In AOTI, the inclusion of a polyUb sequence to a fusion protein of the invention results in a detectable or significant increase in MHC I-mediated activity with respect to one or more antigens of the fusion protein.

In AOTI, one, most, generally all or all of the Ub sequences of a fusion protein are positioned at or near the N-terminus of the fusion protein (e.g., in the first 10%, first 20%, or first 25% of the amino acid sequence). In aspects, one or more Ub sequences are positioned in the middle of the fusion protein. In AOTI, a fusion protein is provided that lacks any Ub sequences in the C-terminal $\frac{1}{3}^{rd}$, $\frac{1}{4}^{th}$, or $\frac{1}{5}^{th}$ of the fusion protein, or lacks any Ub sequence at the very C-terminus of the fusion protein. However, in some aspects a fusion protein will comprise one or more Ub sequences in such a C-terminal portion of the fusion protein. In some aspects, such C-terminal Ub sequences are metabolically stable and not cleaved from the fusion protein. In AOTI, such metabolically stable Ub sequences are still able to detectably if not significantly induce proteasomal degradation of some, most, generally all, or all of the amino acid sequence(s) associated with the Ub sequence.

In AOTI, the PTPS, such as Ub(s) exhibit the ability to DOS enhance CD8+ responses against one or more antigens associated with the Ub in a fusion protein, such as a Ub:gD:antigen fusion protein, Ub:gD:antigen gD fusion protein, or a Ub:gD:antigen:Ub:antigen:gD:antigen fusion protein. In AOTI, such a fusion protein comprises one or more subdominant epitopes or a composition comprises a separate nucleotide sequence encoding a Ub:subdominant epitope fusion protein that is expressed independently but in association with expression of a gD:antigen fusion protein and the presence of the Ub detectably or significantly enhances one or more immune responses to the subdominant epitope, such as a CD8+ response.

In AOTI, the Ub sequence is cleaved from the fusion protein. In AOTI, the Ub sequence acts as a cleavage site, creating two polypeptides, the Ub-associated polypeptide and a second polypeptide. In this respect, some polypeptides comprising Ub sequences can act as multi-cistronic, e.g., bicistronic constructs, which are discussed in more detail above. Such applications are exemplified in US20150266945.

In one aspect the Ub contained in a fusion protein encoded by a construct of the invention is or comprises a K48 chain Ub. In one aspect such constructs and fusion proteins are associated with detectably or significantly enhanced levels of proteasomal targeting of the fusion protein, fusion protein degradation, MHC antigen presentation, or a combination of any or all thereof. In AOTI, the fusion protein also or alternatively comprises or consists of one or more K63-linked Ubs. In such aspects, the fusion protein or construct is detectably or significantly associated with detectably or significantly enhanced DNA repair, ribosomal biogenesis, degradation of the fusion protein, or a combination thereof. In AOTI, the fusion protein comprises both a K63-linked Ub and a K48-linked Ub and the fusion protein is associated with a detectable enhancement in fusion protein degradation as compared to a fusion protein comprising either one type of Ub on its own.

In AOTI, one or more Ub sequences contains seven lysine residues that can serve as substrates for ubiquitination, enabling the generation of seven different inter-ubiquitin linkage types. In AOTI, the Ub comprises an amino-terminal methionine (M1) that can act as a Ub acceptor site. In AOTI, however, the Ub or polyUb of the fusion protein lacks an N-terminal Met residue. It will be understood that the discussion of the characteristics of Ub sequences herein can be applied to polyUb fusion proteins and, as such, the disclosure of any aspect with reference to a Ub sequence of any type or characteristic will be understood as providing implicit support for polyUb sequences comprising one or more Ubs of such type or having such characteristics. PolyUbs encoded by a fusion protein, formed by further ubiquitination of expressed fusion protein Ub sequences, or both, can exhibit any suitable PolyUb form. In AOTI, the fusion protein encodes a linear polyUb form or a branched polyUb; forms a linear polyUb or branched polyUb, or both. Various forms of polyUb are discussed in, e.g., Rieser E et al. Trends Biochem Sci. 2013; 38(2):94-102.

In AOTI, FPs comprising 1+ Ubs that are modified to enhance stability of the Ub sequence and are associated with reduced cleavage of the Ub sequence. One example of such a Ub sequence is Ub-G76A, featuring a Gly76 to Ala76 mutation of the last residue of a typical Ub sequence. In aspects, G76 is substituted with another non-polar amino acid residue, such as I, L, or V.

In AOTI, the fusion protein comprises only PTPS or ERTPS targeting sequences. In AOTI, the fusion protein lacks any lysosomal targeting sequences (e.g., SEQ ID NO:514). In other aspects, the fusion protein will comprise one or more lysosomal targeting sequences in addition to one or more PTPSs, and optionally also one or more ERTPSs.

The Ub sequence(s) incorporated from the fusion protein can be of any suitable source or composition. In AOTI, Ub sequence(s) are from the species that is the primary target for the CEPESC. Thus, for example, the Ub sequence(s) can be, e.g., pig, cow, horse, dog, cat, or human Ubs, functional fragments thereof, polyUbs that are a mixture thereof, and can comprise functional variants thereof which are, e.g., highly related or substantially identical to one or more naturally occurring Ub sequences or functional fragments thereof. In AOTI, the Ub sequences are from a naturally occurring Ub, a functional fragment thereof, or both, as in the case of a polyUb comprising complete and partial naturally occurring Ubs.

A ubiquitin sequence can correspond to any type of naturally occurring Ub sequence or a functional fragment or variant thereof. In many organisms, ubiquitin is encoded by 4 different genes. For example, the UBA52 and RPS27A genes code for a single copy of ubiquitin fused to the ribosomal proteins L40 and S27a, respectively, whereas the UBB and UBC genes code for polyubiquitin precursors (polyUb and polyUC) with exact head to tail repeats, the number of repeats differ between species and strains.

In AOTI, the fusion protein comprises at least one Ub that also or alternatively is a Ub or Uc precursor sequence, such as a polyubiquitin B sequence (which comprises three direct repeats of a typical ubiquitin coding sequence with no spacer sequence). An example of such a ubiquitin B polyUb is SEQ ID NO:1, GenBank Accession No. AAA31133.1.

A Ub or polyUb can be placed in any suitable orientation in the fusion protein. In AOTI, a Ub, such as a polyUb, is placed downstream of one gD sequence and upstream of a second gD sequence, such as a first gD sequence that is an N-terminal gD sequence fragment or variant and a second gD sequence that is a C-terminal gD fragment or variant or two partial or complete gD sequences that overlap in terms of structure/composition. In one such case, the Ub sequence may be placed indirectly or directly adjacent to one or more antigenic sequences that are also positioned between the gD sequences (e.g., a sequence according to the structure gD1-antigen-Ub-gD2). In another example, a fusion protein can comprise two Ub sequences, such as polyUb sequences, positioned between gD sequences with an intervening antigenic sequence (e.g., according to the structure gD1-antigen-Ub1-antigen-Ub2-gD2). In yet another aspect, the invention provides gD:antigen fusion proteins according to the formula Ub1-antigen(x)-Ub2-gD (antigen(x) signifying that the region can contain two or more antigens, such as 2-10, 3-12, 4-12, 3-9, 4-8, or 2-6 antigens). Another type of fusion protein comprises a sequence according to the formula gD1-Ub-antigen(x)1-Ub2-antigen(x)2-gD2. Still another fusion protein type comprises a sequence according to the formula Ub-antigen(x)-Ub2-antigen(x)2-gD (e.g., where the C-terminal gD primarily consists of or generally consists of a gD profusion domain). Still another example of a fusion protein of the invention is a trap protein, such as PDL1 trap (discussed further below) in combination with Ub, antigenic, and gD sequences, such as a sequence according to the formula PDL1trap-Ub1-antigen(x)-Ub2-gD (other trap proteins, such as a DEC-205 trap, could be used in place of the PDL1trap in such a fusion protein). In any of these fusion proteins, one, two, three, four, or more spacer sequences can be introduced between the Ub sequences and other sequences, between the antigenic sequences, or in any other suitable position.

In AOTI, Ub sequences of a fusion protein are modified so as to remove one, some, most, generally all, or all of any potential glycosylation sites in the Ub sequence, such as by introducing one or more N-to-D substitutions in the Ub sequence, as DEH with respect to certain antigenic sequence variants.

Ubiquitin conjugated fusion proteins are KITA and sequences from such ubiquitin FPs can be ATAOTI. Ubiquitin-fused genetic vaccines that enhance both antigen degradation and immune presentation ATAOTI are described in, e.g., M. A. Barry et al, Nature, 377 (1995), pp. 632-635; T. W. Tobery, et al. J. Exp. Med, 185 (1997), pp. 909-920; F. Rodriguez et al. J. Virol, 71 (1997), pp. 8497-8503; G. Delogu et al. Infect. Immun, 68 (2000), pp. 3097-3102. Additional PMCs related to Ub sequences, proteasomes, and the like are described in Li W et al. Cell Mol Life Sci. 2008; 65(15):2397-2406; Yasushi Saeki et al. *The Journal of Biochemistry*, Volume 161, Issue 2, Pages 113-124; U.S. Pat. No. 6,319,503 & 8858951; Röth S, et al. *Cell Mol Life Sci.* 2019; 76(14):2761-2777; Trauth et al., ACS Omega 2019, 4, 2, 2766-2778, Feb. 6, 2019; and Nathan J A et al. EMBO J. 2013; 32(4):552-565. Still additional related PMCs are described in US 20090221682; US20040170643; U.S. Pat. No. 9,079,966; Dutton J L, et al. PLoS One. 2013; 8(10): e76407; Chen J H, et al. Hepat Mon. 2011; 11(8):620-628; and Wong S B et al. J Immunol. 2004; 173(5):3073-3083.

In aspects, FPs comprise one or more ubiquitin-like (UbL or UBL) sequences, which either correspond to naturally occurring ubiquitin-like proteins, comprise functional fragments of such proteins, or comprise a functional variant of such a protein or fragment, such as a variant that is very related or substantially identical to such a wild-type UbL protein (UBLP). In this disclosure a UBLP means any member of the UBL family of proteins that is not a ubiquitin. Members of the UBL family are small, non-enzymatic proteins that share a common structure exemplified by ubiquitin, which has 76 amino acid residues arranged into a "beta-grasp" protein fold consisting of a five-strand antiparallel beta sheet surrounding an alpha helix. The beta-grasp fold is widely distributed in other proteins of both eukaryotic and prokaryotic origin. Collectively, ubiquitin and ubiquitin-like proteins are referred to as "ubiquitons."

In AOTI, FPs comprise UBL sequence(s) capable of conjugation (sometimes known as Type I UBL). Examples of UBLs that exhibit such properties include SUMO, NEDD8, ATG8, ATG12, URM1, UFM1, FAT10, and ISG15 UBLs. In aspects, the fusion protein comprises a UBL that does not exhibit covalent conjugation (a Type II UBL). Another example of a UBLP is a Rad23 protein (e.g., human Rad23b), examples of which are KITA (Goh A M et al. BMC Biochem. 2008; 9:4. Published 2008 Jan. 30, and Liang R Y et al. J Mol Biol. 2014; 426(24):4049-4060. Still another example of a UBL is NEDD8 and its counterpart NUB1, which works by recruiting NEDD8 and its conjugates to the proteasome for degradation. Sequences according to the formula A(X4)L(X10)L(X3)L are conserved in these NEDD8-binding sites among human and other mammals and can be incorporated into FPs to promote proteasomal processing/targeting. SFE Tanaka T et al. J Biol Chem. 2003; 278(35):32905-32913.

In AOTI, the fusion protein comprises a UBL sequence that can also or alternatively be characterized as a functional sequence of a ubiquitin-like modifier (ULM) UBLP or a functional variant thereof. In aspects, the fusion protein comprises a functional sequence of a ubiquitin-like domain protein (UDP) or a functional variant thereof. Ubiquitin-like modifiers are attached to proteins reversibly and post-translationally, like ubiquitin. Ubiquitin-like domain proteins are larger than ubiquitin and typically contain multiple domains, with only one homologous to ubiquitin. In AOTI, the fusion protein comprises a UBL sequence or ubiquitin sequence that detectably binds the proteasome.

(b) Degrons and Ub-Targeting Sequences

In AOTI, a fusion protein of the invention, such as a gD:antigen fusion protein, also or alternatively comprises one or more degrons. In AOTI, the one or more degrons of the fusion protein detectably enhance the targeting of the fusion protein to the proteasome, processing of the fusion protein by the proteasome, or both. In AOTI, the fusion protein comprises one or more UBL sequences or ubiquitin sequences and one or more degrons.

A "degron" (degradation sequence) typically is a small, "portable" sequence that contains the minimal element in a PPT sufficient for recognition and degradation by a proteolytic apparatus. A degron also typically is a portion of a protein that is important in regulation of protein degradation rates.

FPs can comprise one, two, or more degrons. The degrons can be any suitable type of degrons. In AOTI, the one or more degrons detectably or significantly enhances degradation of the fusion protein. In the case of proteasomal degradation, a specific degron might initiate polyubiquitylation by an E3 ligase or might target the substrate directly to the proteasome. Either such type of degron or both types can be incorporated into FPs OTI.

In AOTI, the invention provides fusion proteins comprising one or more degrons composed of 6 to 10 amino acids. In AOTI, one, most, generally all or all of the degrons of a fusion protein are located within flexible regions of the fusion protein, enabling interaction with other proteins (e.g., ubiquitin, E3 ubiquitin ligase, etc.). Thus, a degron, in some aspects, can be associated with flexible flanking sequences, such as one of the flexible linkers described elsewhere herein. In aspects, FPs comprise one or more degrons that comprise one or more Lys or Arg residues that are structurally exposed.

In AOTI, FPs comprise one or more degrons that are "Ubiquitin-dependent." In AOTI, the fusion protein also or alternatively comprises one or more degrons that can be characterized as "Ubiquitin-independent." In the first case intracellular protein degradation is mediated largely by the ubiquitin (Ub)-proteasome system (UPS) and in the second case by autophagy-lysosome pathways, with molecular chaperones being a part of both systems.

In AOTI, a fusion protein of the invention comprises an N-degron, a C-degron, or a combination thereof. N-degrons and C-degrons are degradation signals whose main determinants are, respectively, the N-terminal and C-terminal residues of cellular proteins. N-degrons and C-degrons include, to varying extents, adjoining sequence motifs, and typically also internal lysine residues that function as polyubiquitylation sites.

The UPS comprises a set of pathways that have in common two classes of enzymes: E3-E2 Ub ligases and deubiquitylases (DUBs). A Ub ligase recognizes a substrate protein through its degradation signal (degron)

Degrons can AOA further be generally divided into two major groups, based on the characteristics of the signal that triggers degradation. Inherent degrons, permanently present in proteins and acquired degrons that are induced by post translational modifications (PTMs). Inherent degrons can be specific amino acid sequences, such as the destruction box of cyclins, or N- and C-terminal amino acids corresponding to the N-degron and the C-degron pathways mentioned above. In addition, a large portion of inherent degrons consists of hydrophobic sequences, normally buried in the protein core, or within interaction surfaces between subunits of protein complexes. These degrons are frequently exposed when proteins fail to fold properly, upon protein misfolding or when protein complexes fail to assemble. The exposure of hindered degrons can be induced by multiple mechanisms, including changes in the environmental or intracellular conditions as well as by genomic mutations. These perturbations initiate a protein quality control (PQC) response that either assists misfolded protein re-folding or triggers elimination by the UPS.

Unlike inherent degrons, acquired degrons are transient elements obtained via PTMs, such as phosphorylation, ligation of Small Ubiquitin-like Modifier (SUMOylation) and hydroxylation. Protein phosphorylation is by far the most common PTM that triggers ubiquitylation via E3 Ub ligases.

A degron that leads to the degradation of a folded protein typically has two parts. Most proteins appear to be targeted for degradation by the covalent attachment of a tag that consists of several copies of the small protein ubiquitin. However, ubiquitinated proteins are stable, at least in vitro, unless they also contain an unstructured region, which is then the second component of the degron. In AOTI, the invention provides fusion proteins in which both components are contained in one or more degrons on a single chain of a polypeptide. In aspects, the invention provides fusion proteins wherein one or more of such elements is on one chain and the other on or at least also on a second chain of a multimeric protein, such as a multimeric trap fusion protein of the invention. As noted, In AOTI, a degron-containing fusion protein of the invention will typically comprise at least one ubiquitin target sequence/site. However, In aspects, the invention provides fusion proteins comprising one or more unstructured regions that lack ubiquitination sites, which detectably or significantly promotes proteasome targeting, protein degradation, or both (SFE Schrader E K et al. Nat Chem Biol. 2009 December; 5(12):954). Additional relevant disclosures are provided in Mészáros et al. Science Signaling14 Mar. 2017 Vol. 10, Issue 470; Alexander Varshavsky, PNAS. January 2019, 116 (2) 358-366; and Greussing R et al. J Vis Exp. 2012; (69):3327. Published 2012 Nov. 10.

In AOTI, FPs comprise one or more D box degrons, KEN box degrons, ABBA degrons, or a combination thereof.

D box degrons follow the consensus R[KR][AP]Lx[DE][ILV][TS]N. Such a peptide would likely have a relatively high binding affinity. In AOTI, the +6 position of such a sequence if phosphorylated in the D box degron of the fusion protein. Examples of D box degrons include SEQ ID NOs: 535-567.

In aspects, FPs AOA comprises one or more KEN box degrons. KEN box degrons are named because they contain the characteristic K-E-N motif (however, in some cases such degrons contain a GxEN motif). Examples of such degrons which can be included in FPs include SEQ ID NOs:568-589.

In aspects, FPs AOA comprises 1+ ABBA degrons. ABBA degrons typically comprise a structure according to the formula [ILMVP][FHY]x[DE], [FILV]x[ILMVP][FHY]x[DE], or [KR]xx[ILV][FHY]x[DE]. A lysine in the floor of the ABBA binding pocket conserved across all characterized ABBA binding domains (human Cdc20, yeast Cdh1 and yeast Cdc20) is a serine in human Cdh1 and the portion of blade contacting the conserved lysine, conserved in human Cdc20, yeast Cdh1 and yeast Cdc20, has diverged significantly in Cdh1. Examples of ABBA degrons that can be in FPs include SEQ ID NOs:590-594.

Other types and examples of degrons suitable for inclusion in FPs are KITA and include, e.g., LLRL tail degrons, IR tail degrons, etc., such as SEQ ID NOs:595-597. Another example of an amino acid sequence degron is the Cop1-binding Trib peptide (SFE WO2019118893).

FPs can also comprise other sequences that target FPs for ubiquitination. Identification of ubiquitin sites that can be incorporated into fusion proteins of the invention is discussed in, e.g., Nguyen, V et al. BMC Bioinformatics 16, S1 (2015). In aspects, FPs comprise or a composition can comprise a nucleotide sequence encoding an E3 ligase ligand, which can promote or enhance polyubiquitination, or an E3 ligase variant, or a fusion protein comprising such an E3 ligase sequence. Proteolysis-targeting chimeras (PROTACs) comprising E3 ligase sequences have been developed that can be used in compositions of the invention or sequences therefrom incorporated into expression products of the invention (SFE Qi J, Zhang G. Future Med Chem. 2019; 11(7):723-741, for a discussion of PROTACs). Other Ub-targeting sequences are described in Adams, Trends Mol Med. 2002; 8(4 Suppl):S49-54).

In AOTI, FPs comprise 1+ degradons. A degradon is a sequence comprising a target binding domain and a proteasome-binding domain (e.g., a Ub or ULP domain). A degradon can comprise from N-terminus to C-terminus (a) the target binding domain and (b) proteasome binding domain or from N-terminus to C-terminus (a) proteasome binding domain and (b) the target binding domain. Optionally, the degradon can comprise a linker sequence positioned between the target binding domain and proteasome binding domain. Degradons are described in WO2017079723 and US20050152888.

In AOTI FPs comprise an E3 ligase e.g., CHIP (carboxyl terminus of Hsc70-interacting protein), 1+ cytosolic chaperons (e.g., Hsp70/Hsp90), or CT.

As noted, in some aspects fusion proteins comprise both one or more degrons and one or more Ubs or UBLP sequences. Examples of fusion protein sequences comprising both degrons and Ubs/UBLP sequences are described in, e.g., Inobe T, et al. Biochem Biophys Res Commun. 2018; 501(4):948-954 and US 20180327462. PEST degron FPs comprising Ub AARSs are described in US20190322714.

2) ERTPSs and ERAD-associated Factors

In aspects, FPs/EPs comprise one or more sequences that are heterologous to the referenced sequence(s) and target the endoplasmic reticulum (ER), promotes processing of the polypeptide in the ER, or both. Such a heterologous sequence can be referred to as an ER targeting/processing sequence or "ERTPS." Such FPs, which can be gDAgFPs or other FP EPs comprising one or more ERTPSs and one or more other referenced sequences, e.g., one or more antigens that are not associated with any gD sequences.

ER targeting/processing sequences can be, but may not be limited to, any ER targeting sequence which promotes the transport of a translation product into the ER. Once in the ER, such a translation product can be cleaved and presented by MHC class I molecules to drive an optimal immune response.

Many ER-targeting/processing sequences are known in the art and fusion proteins comprising ERTPSs can comprise any suitable type and number of ERTPSs. Examples of such sequences are described in U.S. Pat. No. 5,846,540; EP 2167123; Fu™ et al. J Virol. 1998; 72(2):1469-1481; Xu W et al. Virology. 2005; 334(2):255-263. doi:10.1016/j.virol.2005.01.040; Sher Y P et al, Am J Cancer Res. 2019; 9(9):2028-2036; Martinez-Puente D H et al. Cell Stress Chaperones. 2019; 24(1):149-158. doi:10.1007/s12192-018-0952-8; & Wang L, et al. Eur J Immunol. 2004; 34(12): 3582-3594. doi:10.1002/eji.200425215.

In AOTI, a fusion protein encoded by a construct of the invention comprises an ERTPSs selected from SEQ ID NOs: 511 and 598-642. Another exemplary ER targeting sequence encoded by SEQ ID NO:643 is described in Ciernik, et al (1986) Journal of Immunology. This sequence encodes an E3/19K protein of adenovirus type 2, which comprises SEQ ID NO:644, which promotes ER retention and processing of associated sequences. See also, Anderson, K. et al., J. Exp. Med. I74:489 (1991). A similar E3 sequence of Ad2 is SEQ ID NO:645. In aspects, such a sequence is combined in the fusion protein with one of the 4-mer retention sequences described above, such as the well-studied KDEL sequence. Other sequences KITA also have been shown to have ERTPS effects including tPA sequences, calreticulin sequences (which is discussed above), and the IgKappa-chain leader sequence. Fusing an Ag with the chaperone Grp170 substantially can facilitates Ag access to the ER and could strengthen ER-associated protein degradation and antigen presentation.

Fusion protein-encoding constructs can AOA comprise 1+ sequences encoding one or more ERAD-associated factors. In other aspects, FPs lack any ERAD-associated factor-encoding sequences. ERAD is an abbreviation for "ER-associated protein degradation." ERAD substrates are poly-ubiquitinated, which marks them for degradation by the 26S proteasome. As such, in aspects FPs comprise both a PTPS, e.g., 1+ polyUb sequences, and optionally one or more additional ERAD factors. Alternatively, a composition can comprise a nucleotide sequence that encodes one or more ERAD factors separately from any PTPS-containing FPs (e.g., a ubiquitinated FP).

Key mediators of ERAD substrate selection that can be encoded by nucleotide sequences for expression in the compositions and methods of the invention are ER-resident lectins and molecular chaperones, such as BiP, an ER-luminal heat shock protein of 70 kDa (Hsp70). ER lectins include calnexin and calreticulin, which promote ER retention of certain glycoproteins and ERAD targeting. Chaperones, such as BiP recognize peptides that are enriched in hydrophobic amino acids and target such proteins for ERAD. Other factors involved in ERAD also can aid in proteasomal processing of proteins, such as Herp, Hrd1, and Derlin-1, and ubiquitin ligases such as gp78, TRC8, and Doa10/TEB4. Herp also is a UBLP, reflecting, again, the overlap in the functionality of such factors and, indeed, degrons also can promote ERAD. However, while there is such overlap between ERAD factors and PTPS-related factors, ERTPSs and PTPSs are distinct and, used individually or in combination, reflect unique approaches to the processing of related fusion proteins. Additional principles and compositions related to ERAD factors are discussed in, e.g., Ahner A et al. Trends Cell Biol. 2004; 14(9):474-478; Morito D, et al. Mol Cell. 2015; 59(3):335-344; Smith N et al. J Biol Chem. 2016; 291(29):15082-15092; and Ilana Shapira et al., Journal of Cell Science 2007 120: 4377-4387.

Alphaherpesvirus gD sequences also can promote ER targeting and processing. Such aspects of gD sequences are DFEH. In AOTI, a fusion protein comprises a gD sequence that promotes ER targeting/processing as well as at least one additional ERTPS. In AOTI, a fusion protein comprises a gD sequence that promotes ER targeting/processing and 1+ or 2+ heterologous ERTPSs, such as an E3 sequence, KDEL, or both. In still another aspect, a fusion protein also or alternatively further comprises or an associated nucleotide sequence also or alternatively encodes and expresses one or more sequences involved in PTPS processes as well as ER processes, such as ERAD, such as one or more degrons, ubiquitin ligases, ER lectin, chaperone, etc.

In AOTI, the inclusion of one or more ERTPSs detectably or significantly enhances ER processing. In AOTI, the inclusion of one or more ERTPSs also detectably or significantly enhances one or more aspects of immune response associated with the administration and expression of the construct, such as MHC I IR(s) or MHC II IR(s).

In AOTI, a composition is provided that comprises one or more NAMs encoding at least two separate/distinguishable fusion proteins, each of the at least two fusion proteins comprising one or more antigens, and the first of the at least two fusion proteins comprising one or more PTPSs (and optionally lacking any ERTPS) and the second comprising an ERTPS (and optionally lacking any PTPSs). In AOTI, the two fusion proteins are encoded by distinct sequences contained in different NAMs of a composition or a method is employed in which such different NAMS are associatively administered, such as through co-administration or sequential administration.

c. Extracellular Targeting Sequences (ETSs)

In aspects, CEPs comprise ETS(s). An ETS is an AARS that DOS binds to a target presented outside of COEs (on another cell or in the milieu/microenvironment of the cell). An RBD is a typical type of ETS, but other types of ETSs also are within the broadest meaning of the term.

An EP can comprise any suitable type of ETS and any suitable number of ETSs. Typically, a single PPT will comprise a single ETS. However, in aspects, a single PPT can be bi-specific, comprising 2 ETSs. Single PPTs can also comprise additional ETSs (e.g., a WT gDP typical targets 3 different receptors). Multimeric PPTs often are multi-specific. E.g., Ab PPTs are often bispecific and other multimeric PPTs can be specific for 3, 4, 5, or more ETSs.

1) Immune Cell TSs (ICTSs)

In AOTI, constructs encode one or more fusion proteins comprising at least one sequence that effectively binds to one or more receptors on one or more immune system cells ("immune cell targeting sequences" or "ICTSs"). Effectiveness in terms of the binding of an ICTS to an immune cell receptor means at least a detectable levels of binding, typically a significant level of binding, and often further a level of binding detectably or significantly associated with one or more receptor binding-associated cellular/physiological events, such as uptake of the FP, inducement of a receptor binding-mediated effect, IR enhancement(s), or a combination of any or all thereof.

In AOTI, an ICTS binds ≥2 receptors, e.g., as many gD proteins bind ≥2 receptors (including HVEM & Nectin-1 WRT HSV-1 gD and Nectin-1 and Nectin-2 WRT HSV-2 gD). In AOTI, an ICTS also or alternatively can bind to multiple homologs of one or more types of receptors (e.g., as PRV gD is expected to bind both human Nectin-1 as well as its porcine homolog). In AOTI, one or more ICTSs of a fusion protein preferentially bind or specifically bind one type of sequence, such as a receptor and homologs thereof.

In aspects, an EP comprises ≥1 ETS. In aspects, an EP comprises only 1 ETS. In aspects an ETS is positioned at a terminus of the EP or near such an AARS terminus (e.g., within 20%, 15%, or 10% of the terminus based on number of AAs). In aspects, ETSs are positioned on or near both termini of an EP. In aspects, 1 ETS is positioned at or near an EP terminus. In aspects, the ETS is an RBD (e.g., a WT RBD, FF, or FV).

In AOTI, the target immune cell(s) that comprise the target receptor bound by one or more TS(s) of FP EP(s) can be characterized as being antigen-presenting cell(s) or "APC(s)." An "antigen-presenting cell" or "APC" refers to a cell that can process and display foreign antigens in association with major histocompatibility complex (MHC) molecules on its surface. An APC targeted by an extracellular TS can be any suitable APC. Examples of such cells include dendritic cells (DCs), macrophages, Langerhans cells, and B cells. Other cells that can act as APCs include, e.g., γδ-T cells, NK cells and fibrocytes (non-conventional APCs). In AOTI, a fusion protein is expressed from a construct of the invention that comprises a TS for a non-conventional APC. In one example, the invention provides a fusion protein that comprises a TS that binds to one or more targets expressed on γδ-T cells, such as a porcine γδ-T cell, e.g., in a fusion protein comprising one or more ASFV antigens.

In aspects, the target cell can be characterized as an adaptive IC, i.e., a B cell or a T cell). In aspects, the target cell also or alternatively can be characterized as a cell of the innate immune system, such as a macrophage or eosinophil. In still another aspect, the target cell is an ITIC, e.g., a DC or an NKC. A target cell may meet two or more of the categories that define various facets of such AOTI, as in the case of DCs.

(a) DCR Targeting Sequences

In AOTI, a fusion protein of the invention comprises one or more ICTS that target a receptor on at least some dendritic cells. In AOTI, a fusion protein of the invention comprises a gD sequence that effectively binds a dendritic cell receptor (DCR). In AOTI, constructs of the invention encode at least one dendritic cell receptor binding sequence/ligand (a DCR targeting sequence or "DCRT") that is heterologous to naturally occurring gD proteins (and that typically exhibits less than about 40% identity, less than about 30% identity, or less than about 20% identity to one or more wild-type gD proteins/sequences, such as all naturally occurring gD proteins). In AOTI, a fusion protein of the invention comprises a combination of one or more DCR-binding gD sequences and one or more DCR-binding heterologous sequences. In AOTI, the only DCR-binding sequences of the fusion protein are one or more gD sequences. In aspects, the only DCR-binding sequences of a fusion protein are non-gD sequences (in some such aspects the fusion protein comprises non-DCR-binding gD sequences and other polypeptides encoded by constructs of the invention comprising non-gD DCR-binding sequences lack any gD sequences).

In AOTI, a fusion protein comprises one or more DCRTSs that is a sequence of an antibody that binds to a DCR or a sequence that is at least highly related to such an anti-DCR antibody and that effectively binds the DCR. In aspects, a fusion protein also or alternatively comprises a DCRT that comprises a sequence from a naturally occurring ligand for a DCRT or a sequence that is at least related thereto and that effectively binds the DCR. In AOTI, the invention provides fusion proteins that lack any anti-DCR antibody sequences. In AOTI, the invention provides fusion proteins that lack any antibody sequences or any sequences that are highly related or substantially identical to an antibody sequence. Lacking a sequence in this and other respects where such terminology is used in this disclosure can mean that a sequence identical to such a sequence is not present, but any statement in this disclosure will be understood to implicitly also provide support for lacking sequences that are at least highly related to the referenced missing sequence. In AOTI, a DCRTS fusion protein will comprise a synthetic non-antibody DCR-binding sequence. In AOTI, the DCRTS is a multimeric protein, a multivalent protein, or both. One example of a multimeric synthetic DCRTS protein that can be adapted for use in contexts of this invention are the short (12-mer and 6-mer), Lys core trimeric CLEC10A-binding proteins described in Eggink L L et al. J Immunother Cancer. 2018; 6(1):28, which can be adapted to include 1+Ag(s), to bind other DCRs, or both.

In one exemplary aspect, the invention provides fusion proteins that lack any sequences of more than 25 AAs in 1, 2, or 3+ contiguous sequences that collectively exhibit more than about 80% identity, such as more than about 90% identity, such as more than about 92%, more than about 95%, or more than about 97% (e.g., about 98-100%) identity to target-binding sequences of any Ab against any cellular receptors discussed herein.

Any one or more suitable DCRs can be targeted by DCRTs in FPs. Numerous DCRs are KITA. Often DCRs will also be present on other cells, such as is the case with HVEM. In addition to HVEM, examples of such DCRs that can also or alternatively be targeted by DCRTs of fusion proteins of the invention include Langerin/CD207 (relevant principles and compositions discussed in Juliana Idoyaga et al. PNAS. February 2009, 106 (5) 1524-1529; and Idoyaga J et al. J Immunol. 2008; 180(6):3647-3650); mannose receptor (MR); Toll-like receptors (TLRs); C-lectin receptors (CLRs) and other pattern recognition receptors (PRRs) (SFE Lundberg K et al. Immunology. 2014; 142(2):279-288; van Kooyk Y. Biochem Soc Trans. 2008; 36 (Pt 6):1478-1481; and van Dinther D et al. J Leukoc Biol. 2017; 102(4):1017-1034), such as DC-SIGN (DC-specific ICAM-3-grabbing nonintegrin) (relevant principles and compositions, such as ligands and antibodies, are discussed in Jarvis C M et al. PNAS 2019; 116(30):14862-14867; Engering A et al. J Immunol. 2002; 168(5):2118-2126; Zhou T et al. Cell Mol Immunol. 2006; 3(4):279-283; Noll A J et al. Biochem J. 2016; 473(10):1343-1353; Feng D et al. Clin Exp Immunol. 2018; 191(1):107-115; and Cai M et al. J Trans Med. 2013; 11:103; see also US 20080019998), C-type lectin 12a (Clec12a), C-type lectin immunoreceptor (CIRE), and DC-associated C-type lectin 1 (Dectin 1); Heat Shock Protein receptors; CD11c, and other DC-associated integrin receptors; FC receptors, such as the FC gamma receptor (SFE Guilliams M et al. Nat Rev Immunol. 2014 May; 14(5):349 and Nat Rev Immunol. 2014; 14(2):94-108); the CD40 receptor (SFE Ma D Y et al. 2010 June; 22(3):190. Semin Immunol. 2009; 21(5):265-272; CLEC9A (SFE Zhang J G, et al, Immunity. 2012; 36(4):646-657); chemokine receptors such as CCR7, CCR4, CCR6, and CXCR5 (SFE Oppenheim J J et al. Arthritis Res. 2002; 4 Suppl 3(Suppl 3):S183-S188); CLEC10A; MRC1, Dectin-2 (CLEC6A); Mincle; MMR; DNGR-1; DC-ASPGR; LOX-1; BST-2; DCIR (CLEC4A, Clec4A2); f4/80-like receptor (FIRE); DCIR2 (CLEC4A4); scavenger receptor (SR); DCAR1; and dendritic and epithelial cell receptor of 205 kDa ("DEC205" or "DEC-205") receptors (another type of CLR), which are discussed in further detail below (principles related to several of these receptors are discussed in, e.g., Nchinda G et al. J Clin Invest. 2008; 118(4):1427-1436; Sehgal K et al. Immunol Lett. 2014; 162(1 Pt A):59-67; Hossain M K, Wall K A. Use of Dendritic Cell Receptors as Targets for Enhancing Anti-Cancer Immune Responses. Cancers (Basel). 2019; 11(3): 418. Published 2019 Mar. 24; and Hoober J K et al. Front Immunol. 2019; 10:2880. Published 2019 Dec. 11).

In AOTI, the DCRTS(s) of FP(s) comprise AARS(s) that comprises at least a functional fragment of a naturally occurring ligand for the DCR or a variant thereof that has a sequence that is at least related to the naturally occurring ligand and exhibits suitable, similar, or superior functionality as compared to the naturally occurring ligand. Naturally occurring peptide ligands of DCRs include Flt3L, F-actin, myosin II, exposed actin filament proteins, defensins, and chemokines such as SLC/CCL21, ELC/CCL19, and BLC/CXCL13. These and other types of naturally occurring ligands, functional fragments thereof, and functional fragments thereof that are related, very related, highly related, or substantially identical to a functional sequence of the naturally occurring ligand and that suitably, substantially equivalently, or more effectively binds its DCR. In aspects, the invention provides fusion proteins that comprise one or more DCRTs that are antigens known to bind DCRs, such as HCV core protein, HIV envelope protein, and the H. pylori Lewis Antigen.

The DCR(s) targeted by TS(s) are selected based on desired function(s). Some DCRs generate inhibitory signals (e.g., CLEC4A4), whereas others are stimulatory. In AOTI, the invention provides fusion proteins that comprise at least one DCRTS that binds to a stimulatory DCR. In AOTI, the invention provides fusion proteins that only contains DCRTSs that bind stimulatory DCRTSs. In AOTI, such a fusion protein comprises no gD sequences. In aspects, such a fusion protein comprises a gD:antigen portion, such as an antigen-gD profusion domain fusion protein. In either case, such a fusion protein can comprise a gD signal sequence in initial/immature form.

In aspects, the selection of DCRTS also or alternatively is made in consideration of the type of DC(s) to be targeted. In general, fusion proteins of the invention can target any suitable type of DC. In AOTI, a fusion protein comprises a DCRTS that binds to a DCR on myeloid DCs (MDCs) or DCs that are characterized generally as conventional DCs. The MDC targeted by a DCRTS can be BDCA1+ MDCs, BDCA3+ MDCs, or both. In aspects, a fusion protein comprising a DCRT that also or alternatively binds to a DCR on plasmacytoid dendritic cells (PDCs) (e.g., BDCA-2, DCIR, TLR-7, or TLR-9). In AOTI, the DCRTS binds to a DCR on CD8α−/CD1c+ DCs (e.g., DEC-205, DCIR-2, or TLR-7). In AOTI, the DCTRS also or alternatively binds to a DCR on CD8α+/CD141− DCs (e.g., CLEC9A, DNGR-1, TLR-3, DEC-205, and DCAR1). In AOTI, the fusion protein comprises a DCRTS that binds both such types of cells (e.g., a DCTRS that binds DEC-205). In aspects, the DCTRS also or alternatively binds to a DCR expressed in skin DCs (e.g., DC-SIGN, or Langerin). In AOTI, the DCRTS binds to a receptor in DC precursor cells. In aspects, the DCRTS binds to a receptor that is also or alternatively present in immature DCs. In still another aspect, the DCRTS binds a receptor that is also or alternatively expressed in mature DCs. The biology of various DCs and DCRs is discussed in, e.g., Hossain M K et al. *Cancers (Basel)*. 2019; 11(3):418 and Macri C et al. Semin Cell Dev Biol. 2018; 84:11-21.

Because many, if not most, of the ligands for DCRs consist of or comprise non-amino acid sequence components, or are unknown, the use of antibody sequences to bind DCRs can be useful. Numerous effective antibodies to DCRs have already been developed in the art and the development of additional effective antibodies is possible without undue experimentation. From such antibodies, effective DCR binding sequences can be determined and encoded into constructs that express antibody sequence DCRTS fusion proteins, which can be gD:antigen fusion proteins or non-gD sequence fusion proteins. Thus, for example, a fusion protein of the invention can comprise a variable region of an anti-DCR antibody, an effective single-chain variable fragment (ScFv), or an effective combination of anti-DCR CDR regions. Examples of ScFv molecules that target DCRs are described in, e.g., WO 2019/082208.

In AOTI, FPs comprising DCRTSs are multimeric. In AOTI, the multimeric DCRTS fusion protein comprises an antibody multimerization domain. In aspects, the DCRTS fusion protein is a trap protein formed of a multimerization domain and two or more receptor-binding ligand domains.

In AOTI, the DCRTS results in DOS internalization of Ags by MHC class I/II molecules. In AOTI, the DCRTS causes a DOS increase in IR(s). In AOTI, the immune response is a stimulatory immune response against at least one disease-causing agent (the DCRTS promotes immunity rather than tolerance). In AOTI, the DCRTS results in enhanced Th1 response, enhanced CD8+ response, or both, to the disease-causing agent. In AOTI, the presence of the one or more DCRTSs results in a detectable or significant enhancement of both CD4+ and CD8+ T-cell responses. In AOTI, the DCRTS also or alternatively detectably or significantly promotes cross-presentation (i.e., presentation of exogenous antigen by MHC class I). In AOTI, DCRTS FPs induce cross-presentation of AgFPs or co-expressed Ags. In AOTI FP(s) comprise a DCRTS that targets Langerin on Langerhans cells, a TLR, a DC-associated heat shock protein (e.g., by a FP comprising a HSP-binding lectin-like oxidized LDL receptor 1 sequence), or DC-SIGN or DEC-205.

In AOTI, a FP comprising a DCRTS is expressed in the context of cells that are activated by an initial exposure to an ITICSTAP, such as EAT-2. An AOTI is a method of inducing IR(s) comprising activating DCs by, e.g., expression of an ITII-encoding nucleotide sequence or administration of an ITII, such as an EAT-2, followed delivery of DCRTS FP(s).

DEC-205 and DEC-205 Ligands/Keratins

An aspect is a FP comprising a DCRT that binds to a DEC-205 protein (e.g., human DEC-205, porcine-DEC-205, chicken DEC-205, and homologs thereof) (SFE Staines K et al. PLoS One. 2013; 8(1):e51799).

In AOTI, a DEC-205-binding FP is co-administered with a construct comprising one or more sequences encoding one or more DC stimulating factors, such as an ITICSTAP, e.g., an EAT-2 PPT. In AOTI, the DEC-205-binding FP is administered following DC stimulation, such as DC stimulation with an EAT-2 polypeptide or other ITIC IM. In AOTI, a DEC-205-binding FP is administered with 1+ agents that detectably enhance the acidity of the DC microenvironment, detectably improve DEC-205-uptake of the fusion protein or DEC-205-related biological activity, or exhibits a combination thereof.

In AOTI, the presence of a DEC-205-binding sequence or other DCRTS results in DOS enhanced DC binding or DC uptake of the fusion protein (e.g., in one aspect the presence of the DCRTS, such as a DEC-205 TS results in an increase in DC uptake of the associated fusion protein of at least about 20%, at least about 50%, at least about 100% (2×), or at least about 200% (3×)). In AOTI, the delivery of an effective amount of the DCRTS fusion protein results in a detectable or significant increase in the amount of interferon gamma-secreting T cells in the subject receiving the DCRTS FP.

In AOTI, a DEC-205-targeting sequence FP comprises one or more DEC-205-targeting keratin sequences. Portions of certain keratin proteins are ligands for DEC-205. Specifically, DEC-205 recognizes the C-Terminal Gly-Rich Region of certain keratin proteins, such as keratin 1 and keratin 10. Such domains typically include glycine- and serine-rich domains in a a $X(Y)_n$ format, where X represents an aromatic or a long-chain aliphatic residue and Y is either glycine or serine. The $X(Y)_n$ pattern in such domains typically is quasi-repetitive and may form "glycine loops" where the Gly-rich peptides have flexible loop-like structures without rigid conformations. The keratin sequences of the fusion protein are exposed, e.g., by design of the fusion protein (e.g., by connection to a flexible linker). Relevant PMCs are described in Cao L et al *PNAS* 2016; 113(47):13438-13443.

Fusion proteins of the invention also or alternatively can express keratins that additionally or alternatively exhibit other functions than DEC-205 binding. For example, fusion proteins of the invention can comprise kertain-4, keratin-6, keratin-8, keratin-13, keratin-17, kertain-18, keratin-19, or sequences that are known to induce immune cell responses, such as immune cell cytopathic activities, related to pathogenic infection, cancer, or both. Such keratins can act as, e.g., "eat me" signals to immune cells, such as certain innate immunity cells or innate trained immunity cells. In aspects, expression of such keratins can add structural and functional support to cells to resist physical degradation/attack by disease-causing agents, such as pathogenic microbes. Related compositions and principles are described in, e.g., Geisler F, et al. *Cells*. 2016; 5(3):29.

In aspects, fusion proteins of the invention, which may or may include gD sequences, can comprise one or more anti-DEC-205 antibody DEC-205 targeting sequences. Anti-DEC-205 antibodies are known in the art. For example, the vaccine (CDX1401, Celldex Therapeutics, Hampton, N.J., USA) comprises a human anti-DEC205 monoclonal antibody fused to full-length tumor antigen NY-ESO-1 along with TLR agonists resiquimod (TLR 7/8 agonist) and Hiltonol (polyICLC, TLR3 agonist), resulting in robust humoral and cellular immunity against NY-ESO-1 and even in patients where NY-ESO expression was not present in the patient tumor (Sehgal K et al. Immunol Lett. 2014; 162(1 Pt A):59-67) (see also, Hua Y, Jiao Y Y, Ma Y, et al. Int Immunopharmacol. 2017; 46:62-69; Niezold T et al. Immunology. 2015; 145(4):519-533; and Birkholz K et al. Blood. 2010; 116(13):2277-2285), which each describe a fusion protein comprising an anti-DEC205 single-chain Fv fragment (scDEC) and an antigen, an approach that can be applied to DEC-205-targeting sequence FPs). Additional Abs against DEC-205 and related PMCs are described in US 2013/0101593.

In AOTI, the administration of an effective amount of a DEC-205-binding fusion protein, such as by administration of a composition comprising a construct encoding such a fusion protein, results in detectable or significant increase in relevant MHC II products, a detectable increase in antigen presentation, or both. In AOTI, antigen presentation associated with the DEC-205-binding fusion protein is increased by at least about 25%, at least about 33%, at least about 50%, at least about 100% (2×), at least about 200% (3×), at least about 5×, at least about 10×, at least about 20×, at least about 50×, or even at least about 100×. In AOTI, the administration of the DEC-205-targeting sequence fusion protein results in detectably or significantly enhanced IL-2 expression from CD4+ T cells (e.g., expression levels of at least about 0.2, 0.3, 0.4, 0.5, 1, or 1.2 ng/mL). In aspects, the administration of the DEC-205-targeting sequence fusion protein also or alternatively results in a detectable or significant enhancement of TNFalpha expression in the subject or cells (e.g., expression levels of at least about 0.1 or at least about 0.2 ng/mL). In still a further aspect, the administration of the DEC-205-targeting sequence fusion protein also or alternatively results in a detectable or significant enhancement of interferon gamma expression in the subject or immune cells (e.g., expression levels of at least about 0.3, 0.4, 0.5, or 0.7 ng/mL). In an exemplary aspect, the administration of the DEC-205-targeting sequence fusion protein also or alternatively results in at least about 2×, at least about 3×, or at least about 4×, 5×, 10×, or more expression of IL-2, TNFalpha, interferon gamma, or a combination of some or all thereof in the subject or cells. In AOTI, the administration of the DEC-205-targeting sequence fusion protein results in a detectable or significant reduction of the IL-10/IL-2 ratio in the subject or cells. In AOTI, the delivery of the DEC-205-binding fusion protein does not significantly alter the phenotype or functionality of DCs in the subject/milieu. Methods related to such aspects are described in, e.g., Birkholz K et al. Blood. 2010; 116(13):2277-2285. In AOTI, delivery of the DEC-205-binding FP AOA does not DOS induce tolerance to any associated Ags expressed with or contained in the fusion protein. It will be understood in this and other aspects of this disclosure that any aspect described with respect to a subject, animal, vertebrate, cell, or cells, can be extended to the performance of the related method, observance of the effect, and the like, in a related population (e.g., in a statistically significant proportion of a population in an adequately powered and properly conducted clinical trial).

In AOTI, a DEC-205-binding fusion protein will be a multimeric protein, a multivalent protein, or both. In AOTI, the DEC-205-binding fusion protein will comprise one or more other extracellular target TSs (e.g., a gD receptor-binding gD sequence). In AOTI, the DEC-205-binding fusion protein is monospecific. In other aspects, a DEC-205-binding fusion protein is multi-specific (e.g., binding both Nectin-1 and DEC-205). In AOTI, the DEC-205 is a DEC-205-trap protein. In AOTI, the DEC-205-binding trap protein comprises at least one, two, three, five, or more antigenic sequences, wherein the antigen sequences are optionally bound to each other, the DEC-205 TS, or both, by linkers, and the antigens are also or alternatively associated with one or more internal TSs, such as one or more PTPSs, one or more ERTPSs, or both. In AOTI, the DEC-205 trap is administered with an ITII that significantly activates DCs, such as an EAT-2 polypeptide, which is either administered before or expressed with the DEC-205-binding trap protein-encoding construct.

vii. Cell Penetrating Peptides

In aspects, EP(s) comprise cell penetrating peptide sequence(s) (CPPS(s)). Cell-penetrating peptides (CPPs) are short peptides/sequences that facilitate cellular intake and uptake of molecules associated with the CPP through either a covalent bond (an FP) or non-covalent interaction. A CPPS can be either a polycationic CPPS, amphipathic CPPS, or hydrophobic/apolar CPPS. A CPPS can operate by any suitable uptake pathway (e.g., endocytosis, macropinocytosis, etc.). In an aspect, a CPPS is a transactivating transcriptional activator (TAT) of an HIV (e.g., HIV-1) (e.g., RKKRRQRRRR (SEQ ID NO:729)). In other aspects CPPSs are of or are FF or FVs of one or more of antennapedia, transportan, polyarginine, penetratin or any of the other CPPs described I CYTOPLASMIC VESICLES—ADVANCES IN RESEARCH AND APPLICATION: 2013 Edition (Q Ashton Acton, General Ed.) (ISBN: 978-1-481-69922-8) (SFE pgs. 68-69). In aspects, a CCPS-associated EP has a size of between about 30 kDa and about 150 KDa (e.g., about 30-120 kDa, about 30-100 kDa, or about 30-80 kDa). Additional CPPs and aspects thereof that can be adapted to such AOTI are described in, e.g., Ziegler A et al. Biochemistry. 2005; 44(1):138-148; Milletti F (August 2012). Drug Discovery Today. 17 (15-16): 850-60; & Stewart K M et al. Organic & Biomolecular Chemistry. 6 (13): 2242-55. In AOTI, an EP comprises ≥1 CPPSs. In AOTI, an EP comprises only 1 CPPS. In AOTI, a CPPS is placed at a terminus or in the first/last 20% of an AARS of a FP. In aspects, a CPP is placed on the opposite end of a FP from an RBD. In aspects, the CPPS is indirectly bound to the rest of the FP, e.g., through a FL, MSL, or MSFL.

viii. Antigens, Epitopes, and Immunogens

Constructs can comprise 1+ antigen-encoding sequences (AgESs), expressed as antigens (Ags) and inducing IR(s) in TR(s) and cells. AgESs can be delivered & expressed in any suitable manner to induce such IR(s).

In aspects, NAMs may be taken up by APCs such that AgESs are expressed in APCs and directly presented to lymphocytes to elicit a cellular and/or humoral immune response. In AOTI, the NAM is targeted in one or more ways so as to detectably or significantly promote uptake by APCs. For example, association with some transfection-promoting agents, such as calcium phosphate nanoparticles, may be associated with a detectably or significantly rate of uptake by APCs. Construct AOA can be contained in a vector that comprises one or more elements that specifically target an APC (e.g., an adenoviral vector comprising a sequence that targets a DCR).

In aspects, constructs comprising AgESs, such as gDAgFPESs, AOA taken up by other cells of the subject or milieu (e.g., fibroblasts, epithelial cells, carcinoma cells, neurons, other immune cells (e.g., T cells or B cells), etc.). An EA of an expressed FP is thereafter released from COEs and taken up by APCs in the subject or microenvironment/milieu, such as DCs. In aspects, a fusion protein can comprise one or more APC targeting sequences, such as a DCRTS.

Regardless of how the antigens encoded by the AgES reach APCs, it is expected that such antigens will be bound to major histocompatibility complex (MHC) class I and II molecules and brought to the surface of the antigen presenting cell along with the associated MHC molecules. The surface antigens are then expected to be presented to immature T cells containing the cluster of differentiation 8 transmembrane glycoprotein (CD8+ T cells) and CD4+ cells. In the case of MHC class I presentation, this can result in the activation of the immature CD8+ T cells into mature antigen-specific CD8+ T cells (also known as cytolytic T cells or killer T cells), which subsequently target and kill cells expressing the antigen or a related, endogenous antigen, thereby providing a therapeutic or prophylactic immunity effect in the subject or milieu.

CEPESCs can encode any number of suitable antigens, each being any suitable type of Ag. The term "antigen" is known in the art and, accordingly, is not limited to any specific definition herein. In general, an antigen refers to a molecule containing one or more epitopes (either linear, conformational, or both) that will stimulate a host's immune system, typically to make a humoral (B-cell) and/or cellular (T-cell) antigen-specific response. Terms such as "antigenic protein" or "antigenic polypeptide" is a polypeptide as defined above which contains at least one epitope. An "antigenic fragment" of an antigenic protein is a partial sequence of said antigenic protein comprising at least one epitope. An "antigenic sequence" refers to an amino acid sequence comprising at least one epitope. The term antigen is sometimes abbreviated as "Ag." Although antigens have been well-studied and are well-understood in the art given the centrality of antigens to the invention they are nonetheless discussed extensively here. Again, such description is meant to illuminate certain aspects of the invention and should not be deemed limiting.

Antigens in the context of fusion proteins and constructs of the invention are peptides. An antigenic sequence (antigen/Ag) can be of any length, ranging in size from a few amino acids in length to hundreds of amino acids in length (e.g., an antigen can be 1000, 900, 800, 700, 600, 500, 400, 350, 340, 330, 320, 310, 300, 290, 280, 270, 260, 250, 240, 230, 220, 210, 200, 190, 180, 170, 160, 150, 140, 130, 120, 110, 100, 90, 80, 70, 60, 50, 40, 30, 20, 10 or less amino acids in length). An antigen can comprise one epitope or multiple epitopes. FPs can comprise one antigen or ≥2 Ags. Typically, what defines one antigen and separates it from other Ags is its composition, such as its relationship to a naturally occurring DCA-associated Ag (e.g., by being related, very related, highly related, substantially identical, or identical (RVRHRSIOI) to such a DCA-associated Ag, while also retaining suitable, essentially equivalent, or superior antigenicity WRT thereto).

Antigens can be associated with any suitable type of disease-causing agent (DCA), such as a tumor or a pathogen. Thus, examples of known antigens that can be included in EPs include AChR (fetal acetylcholine receptor), ADGRE2, AFP (alpha fetoprotein), BAFF-R, BCMA, CAIX (carbonic anhydrase IX), CCR1, CCR4, CEA (carcinoembryonic antigen), EGP-2 (epithelial glycoprotein-2), EGP-40 (epithelial glycoprotein-40), EGFR(HER1), EGFR-VIII, EpCAM (epithelial cell adhesion molecule), EphA2, ERBB2 (HER2, human epidermal growth factor receptor 2), ERBB3, ERBB4, FBP (folate-binding protein), Flt3 receptor, folate receptor-a, GD2 (ganglioside G2), GD3 (ganglioside G3), GPC3 (glypican-3), GPI00, hTERT (human telomerase reverse transcriptase), kappa-light chain, KDR (kinase insert domain receptor), LeY (Lewis Y), L1CAM (LI cell adhesion molecule), LILRB2 (leukocyte immunoglobulin like receptor B2), MARTI, MAGE-A1 (melanoma associated antigen A1), MAGE-A3, MSLN (mesothelin), MUC16 (mucin 16), MUCI (mucin I), KG2D ligands, NY-ESO-1 (cancer-testis antigen), PRI (proteinase 3), TRBCI, TRBC2, TFM-3, TACI, tyrosinase, survivin, hTERT, oncofetal antigen (h5T4), p53, PSCA (prostate stem cell antigen), PSMA (prostate-specific membrane antigen), hRORI, TAG-72 (tumor-associated glycoprotein 72), WT-1 (Wilms tumor protein), and antigens of hepatitis B, hepatitis C, CMV (cytomegalovirus), EBV (Epstein-Barr virus), and HPV (human papilloma virus). Ags will comprise one or more epitopes, which may or may not be known.

The term "epitope," which also known in the art as an "antigenic determinant," refers to a structural portion of a biomolecule, typically an AARS or collection of AAs, that is recognized by the immune system. Epitope recognition can come in the form of binding of antibodies, B cells, or T cells to the epitope(s). Epitopes bound by antibodies or B cells are referred to as "B cell epitopes" and the epitopes bound by T cells are referred to as "T cell epitopes."

Epitopes for NK cells also have recently been identified (SFE Sim et al. Human NK cell receptor KIR2DS4 detects a conserved bacterial epitope presented by HLA-C. Proc Natl Acad Sci USA. 2019; 116(26):12964-12973). In one aspect of the invention, the FNSs of an NAM of a composition encode at least one NK cell antigen, in addition to one or more T cell antigens (typically at least one MHC-I antigen and at least one MHC-II antigen), and one or more B cell antigens.

Binding with respect to interactions between biological molecules discussed herein typically means "specific binding," as that term is understood in the art (aspects of specific binding are also discussed elsewhere herein). In a typical embodiment, specific binding means binding between one agent, e.g., an antibody or T cell receptor ("TCR") and a second agent, e.g., a respective epitope of the first agent, of $1\times10^5$ $M^{-1}$ or higher, or of $1\times10^6$ $M^{-1}$, $1\times10^7$ $M^{-1}$, $1\times10^8$ $M^{-1}$ or higher (see e.g. Caoili, S. E. (2012) Advances in Bioinformatics Vol. 2012 for a discussion of related principles). In AOTI, Ag(s) exhibit such affinity for Ag-binding immune cell (IC) PPTs, such as TCRs, BCRs, MHC PPTs, etc.

Epitopes usually consist of chemically active surface groupings of molecules such as amino acids or sugar side chains and usually have specific three-dimensional structural characteristics, as well as specific charge characteristics. The term "epitope" generally refers to conformational as well as non-conformational epitopes. Conformational and non-conformational epitopes are distinguished in that the binding to the former but not the latter is lost in the presence of denaturing solvents. T cell epitopes often are non-conformational (i.e., they are linear), while B cell epitopes can be conformational or non-conformational. Epitopes formed from contiguous amino acids (also known as linear epitopes)

are typically retained on exposure to denaturing solvents whereas epitopes formed by tertiary folding (also known as conformational epitopes) are typically lost on treatment with denaturing solvents. Methods of determining spatial conformation of epitopes include, for example, x-ray crystallography and 2-dimensional nuclear magnetic resonance. SFE Epitope Mapping Protocols, in Methods in Molecular Biology, Vol. 66, Glenn E. Morris, Ed. (1996). In AOTI, constructs of the invention encode, a fusion protein comprises, or both, one or more non-conformational/linear epitopes. In AOTI, a fusion protein comprises, compositions of the invention comprise nucleotide sequences that encode, or both, antigens at least primarily comprising linear epitopes. In still a further aspect, the epitopes of a fusion protein or that are encoded by the nucleotide sequences of a composition of the invention will generally consist of, substantially consist of, or consist of linear epitopes. It is possible in any such context that a conformational epitope-containing composition, such as an inactivated viral vaccine, can be administered in association with any such composition of the invention.

Normally, an AARS epitope will include between about 3-24 amino acids such as about 5-20 amino acids, such as about 6-18 amino acids (e.g., about 4-18, 4-17, 5-18, or 5-17 amino acids). Normally, a B-cell epitope will include at least about 5 amino acids but can be as small as 3-4 amino acids. A T-cell epitope, such as a CTL (MHC-I) epitope, will typically include at least about 7-9 amino acids to about 9-11 amino acids, and a helper T-cell (MHC-II) epitope typically will include at least about 12-18 amino acids, most often 13-17 amino acid residues. A T-cell epitope can in one aspect refer to an amino acid sequence or a collection of associated amino acids that is about 7 to about 20 amino acids, such as about 8 to about 18 amino acids (e.g., an 8 to 10 amino acid sequence/collection or a 12 to 17 amino acid collection), which typically can be presented by either an MHC Class I or MHC Class II molecule.

The terms MHC Class I and MHC Class II herein are meant to apply to such molecules from any species and functional variants thereof, rather than indicating such sequences of any species. In this respect, MHC Class I molecules/antigens encompass HLA-A molecules/antigens and MHC Class II molecules/antigens encompass HLA-B molecules/antigens.

In embodiments of the invention, antigenic sequences can comprise flanking sequences in addition to a core epitope sequence, where the core epitope sequence will have the characteristics described above (e.g., being about 7-10 amino acids long, typically 9 amino acid residues long, in the case of an MHC-I sequence). Flanking sequences are typically identical to or highly related to the sequences of the protein from which the core epitope sequence is also derived that flank the antigenic sequence in its endogenous setting. Flanking sequence(s) can be at least about 5, at least about 10, at least about 15, at least about 20, at least about 25, at least about 30, or at least about 40 amino acids in length upstream or downstream of the core epitope sequence. In AOTI, one or more antigens of a fusion protein or other expression product of a construct will comprise both upstream and downstream flanking sequences. In AOTI, the flanking sequence detectably enhances or significantly enhances one or more MHC response to the antigen in a subject. Additional aspects of the invention relating to flanking sequences are DFEH.

Typically, an antigen is derived from a disease-associated biological source, such as a pathogenic organism, virus, or a cancer cell (a "disease-causing agent"). In aspects, an antigen of a fusion protein also or alternatively can be a variant of a disease agent-associated antigen (e.g., an "editope," which are described in detail elsewhere herein). In aspects, an antigen can comprise a synthetic mimotope or a sequence thereof. Mimotopes are macromolecules, in the context of expression products of the invention amino acid sequences, which mimic a naturally occurring antigen, binding the the same receptor or other binding partner with at least substantially similar binding as the binding partner: antigen binding under similar conditions (e.g., +/−about 33%, about 25%, about 15%, or about 10% of the binding affinity of the antigen:binding partner binding). Where appropriate, antigens described herein can be substituted with an appropriate mimotope or antigenic portion thereof. Mimotope sequences can be particularly relevant in the targeting of DCRs given the significant number of non-peptide ligands associated with DCRs. Accordingly, In AOTI, a fusion protein of the invention or other expression product of the invention comprises a DCRTS that is a mimotope or an antigenic portion thereof. In AOTI, one or more mimotope sequences of a fusion protein is/are cancer antigen mimotope(s). In AOTI, one or more mimotope sequences of a fusion is/are pathogen antigen epitopes. Examples of both types of mimotopes are known in the art. SFE Zhao L et al. Expert Rev Vaccines. 2008; 7(10):1547-1555; Kozbor D. Immunol Res. 2010; 46(1-3):23-31; Chen L. Curr Opin Immunol. 1999; 11(2):219-222; and US20080019992A1 (with respect to cancer antigen mimotopes) and Zhong Y et al. Virol J. 2011; 8:542; Magliani W et al. Curr Med Chem. 2004; 11(13):1793-1800; U.S. Pat. No. 7,892,557, US20120148594, US20190070248, & WO2007022557A1 (describing various pathogen-associated mimotopes). Methods relating to the identification of mimotopes are exemplified in, e.g., Li D et al. Int J Biol Sci. 2018; 14(4):461-470; Partidos C D. Curr Opin Mol Ther. 2000; 2(1):74-79; U.S. Pat. No. 7,166,694; and EP 0387276B1. Peptide mimotopes of carbohydrate antigens are described in, e.g., Kieber-Emmons T. Immunol Res. 1998; 17(1-2):95-108. In AOTI, a fusion protein comprising at least one mimotope of a non-protein (e.g., lipid, carbohydrate, or mixture thereof) or modified protein (e.g., glycoprotein or lipoprotein) is provided. In one such aspect, the mimotope targets a receptor on an immune system cell, such as a DC. In some aspects, there can be an overlap in the meaning of the terms "editope" and "mimotope," as some in the art apply the term "mimotope" to modified epitopes (SFE Slansky J E et al. Semin Immunol. 2020; 47:101395). Aspects describing the use of the one type of antigen should be considered to provide support for other and vice versa except where specifically indicated or clearly contradicted.

The term "immunogen" can be used to refer to a molecule that induces, promotes, or enhances one or more immunological responses or that otherwise modulates or interacts with the immune system of a vertebrate. An "immunogenic polypeptide" is a PPT which, when introduced into a vertebrate that similarly induces, promotes, or enhances IR(s) or that modulates or interacts with the immune system of a vertebrate, such as a mammal or a bird. "Immunogenic sequences" are construed similarly.

Antigenic PPTs/AARSs are typically immunogenic (where conformational changes are required to present an epitope an antigenic sequence or polypeptide might situationally not be immunogenic). Immunogenic PPTs & AARSs thus include antigenic PPTs & AARSs, but also can include polypeptides and sequences that primarily upregulate immune system activity through other functions. Examples of such immunogenic PPTs and sequences include cytokines, such as interleukins (ILs) (e.g., IL-2), and innate adaptive immunomodulators, such as EAT-2 PPTs. Immunogens include non-peptidic molecules, such as ISNSs, beta glucans, and lipopolysaccharides.

An "immunological response" or "immune response" ("IR") means any detectable response, such as one or more significant responses, of the immune system or any one or more constituents/components thereof to a factor, event, or a composition in a subject, tissue, cell, cell-containing composition, or a population of any thereof, depending on the context in which the phrase is used. An immunological response in the context of the methods and compositions of the invention can comprise a humoral immune response (mediated by antibody molecules), a cellular immune response (mediated by T-lymphocytes, such as cytolytic T-cells (CTLs), helper T cells, or both), an innate immune response (mediated by cells of the innate immune system, such as macrophages), an innate trained/adaptive immune response (mediated by innate trained immune cells, which currently are known to comprise natural killer (NK) cells (or NKCs) and dendritic cells (DCs), or a combination of two or more thereof), or a combination of some or all thereof. One common component of an immune response will be the increased production of cytokines, chemokines and other such molecules produced by cells of the immune system activated in response to an immunogenic composition. Other aspects of immune responses are described herein. An advantage of many embodiments of the present invention is the ability to produce a detectable, significant, clinically relevant, or effective (significantly therapeutic or protective) immune responses in at least two, often at least three "domains" of the immune system in a subject, such as promoting a T-cell/cellular immunity IR, a B-cell/humoral IR, and an innate adaptive immunity IR. The inventors have discovered that such multi-domain immune responses are often necessary for effective protection or treatment of immunological conditions.

a. Cellular Epitope Recognition

In AOTI, antigens of fusion proteins and other expression products of constructs of the invention are characterized by, possibly in combination with other characteristics of antigens/epitopes described herein, by the type of cells that recognize the antigen. As each type and subtype of immune system antigen-recognizing cell can exhibit different immunological effects, and antigens associated with different cells often have different physiochemical properties, such characterizations of antigens in fusion proteins or otherwise expressed by constructs can help illuminate various aspects of the invention.

1) T Cell Epitope and TCE IRs

In AOTI, FPs or CEPs comprise one or more T cell antigens. In AOTI, an expression of an effective amount of a fusion protein of the invention will result in the detectable or significant expansion in population, increase in activity, or both, of one or more types of T cells that are specific for one or more antigens contained in, expressed with, or otherwise associated with the expression of the fusion protein in a composition comprising competent T cells. T cell antigens incorporated in a fusion protein or other expression product of the invention can target any suitable receptor on any suitable type of T cell, having any suitable characteristics or lineage(s). Examples of specific types of T cells include, e.g., TH1 and TC1 cells.

T cells have been extensively studied and characterized and are only briefly described herein and without limiting the scope of such cells. In general, T cells are lymphocytes that comprise a T-cell receptor on the cell surface. Differentiated T cells (antigen-specific T cells) typically recognize a limited number of epitopes (typically 10s to 100s of structurally related compounds), though some T cells, such as lipid-recognizing CD1-restricted T cells can recognize classes of compound comprising numerous types of compounds within such a class. T cells typically emerge as precursor cells (e.g., CD4-CD8-/double negative T cells), develop into immature/undifferentiated T cells (typical immature T-cells display both CD4 and CD8 proteins (i.e., such cells are CD4+8+ cells)) and further develop into several distinct types of mature T cells, which when exposed to antigens can become antigen-specific T cells. In general, a fusion protein or expression product of a construct can comprise one or more antigens that react with any suitable type of T cell, including immature T cells, differentiated/mature T cells, or both types of T cells. Typically, expression of fusion proteins of the invention will promote, induce, or enhance a detectable or significant response in one or more types of mature/differentiated T cells, lead to a detectable or significant increase in the amount of such T cells, or both.

Differentiated T cells provide distinct immunity-related functions, such as T cell-mediated cell death, carried out by T cells in several ways. CD8+ T cells, also known as "killer cells", for example, are cytotoxic, having the ability to directly targeted cells, to signal other immune cells, or perform both functions. CD4+ T cells, function as "helper cells," indirectly killing targeted cells. Regulatory T cells (sometimes also referred to as "suppressor T cells") are involved in immune tolerance, preventing immune cells from mounting a response against cells recognized as "self." Antigen-naïve T cells expand into antigen-specific T cells. Antigen-specific T cells can be classified as being either "memory T cells" or "effector T cells." Ag(s) can induce IR(s) in any such TCs.

Numerous types of memory T cells are known including tissue-resident memory T (Trm) cells, stem memory TSCM cells, and virtual memory T cells. All such memory T cells appear to be relatively long-lived and can quickly expand to large numbers of effector T cells upon re-exposure to their cognate antigen. By this mechanism they provide the immune system with "memory" against previously encountered pathogens. Memory T cells may be either CD4+ or CD8+. Central memory T cells (TCM cells) express CD45RO, C-C chemokine receptor type 7 (CCR7), and L-selectin (CD62L) (or homologs thereof), and also have intermediate to high expression of CD44. Effector memory T cells (e.g., TEM cells and TEMRA cells) typically express CD45RO, typically have high/medium expression of CD44, and typically lack expression of lymph node homing receptors, CCR7, and L-selectin (or exhibit corresponding presence/lack of homologs thereof). TEMRA stands for terminally differentiated effector memory cells re-expressing CD45RA, a marker also present on naive T cells. Tissue resident memory T cells (TRM) occupy tissues (skin, lung, etc.) without recirculating and are associated with the marker $\alpha e \beta 7$, aka CD103. Virtual memory T cells differ from the other memory subsets in that they do not originate following a strong clonal expansion event & individual virtual memory T cell clones typically reside at relatively low frequencies in organisms. CEPs can induce IRs related to any thereof.

In AOTI, FPs/CEPs generate DOS enhanced number(s) of antigen-specific memory T cells when expressed in effective amounts in an immunocompetent alphaherpesvirus infectable subject vertebrate or a population thereof, result in enhanced immunological memory to the antigens in or otherwise associated with expression of the fusion protein, or both. Such an increase in memory T cells can be in any suitable type of memory T cell, a combination of memory T cell types, or in memory T cells as an overall class of cells. In AOTI, the expression of the fusion protein results in detectably more or significantly more antigen-specific memory cells or other aspects of improved immunological memory than the corresponding peptide antigen or a fusion protein lacking all of the features of the expressed fusion protein or associated construct (e.g., a construct comprising an expression enhancing intron and associated coding sequence encoding a gD:antigen fusion protein comprising one or more antigens associated with one or more ubiquitin sequences and both MHC I and MHC II antigens will result in an improved memory response as compared to a corresponding amount of a construct encoding a gD:antigen fusion protein comprising only either the MHC I or MHC II antigen, lacking the ubiquitin sequence(s), or lacking the expression-enhancing intron sequence). Additional aspects of immunological memory effects associated with compositions and methods of the invention are described further below. The enhanced immunological memory effects of CEPESCs is one of the surprising properties of the inventive compositions and methods provided herein.

T cells also broadly can include Innate-like T cells (e.g., Natural killer T cells (NKT cells), Mucosal associated invariant (MAI) T cells), and Gamma delta T cells). In AOTI, such T cells are outside of the scope of the T cells impacted by, targeted by, or impacted and targeted by the compositions and methods of the invention. However, in other aspects, such T cells are included within the scope of T cells impacted by, targeted by, or impacted and targeted by methods and compositions of the invention. Disclosures related to T cells herein should be understood to simultaneously provide support for application to both these broader and narrower range of T cells.

Most T-cells typically respond to antigen only when it is displayed on specific classes of other cells known generically as an antigen-presenting cells (APCs). APCs, e.g., macrophages and dendritic cells, present antigens derived from polypeptides via glycoproteins, known as MHC (major histocompatibility complex) proteins, which are displayed on the surface of APCs. As noted above, the nomenclature for MHC gene products varies from species to species. For example, human MHC proteins are also referred to as human lymphocyte antigens (HLA), murine MHC proteins are also referred to as H-2 antigens, and rat MHC proteins are called RT1 antigens.

As noted EH, typically CD8+T lymphocytes recognize MHC class I complexes, while CD4+ cells recognize MHC class II complexes on APCs. In MHC-mediated presentation of Ags, the $\alpha$:$\beta$ T-cell antigen receptor recognizes peptide Ags with MHC molecules. Particular MHC proteins bind selected classes of antigens with limited specificity. Typical determinants in a TCR:Ag:MHC complex are (1) the unique sequences of the variable portion of the TCR and (2) the unique sequences of antigen/epitope. However, to some degree, MHC-presented oligopeptide antigens are embedded within an MHC molecule and TCR recognition of antigen only occurs within the context of an appropriate class of MHC molecule (a phenomenon known as MHC restriction). The involvement of CD8 and CD4 in Ag recognition by $\alpha$:$\beta$ TCRs can be significant. CD4 and CD8 molecules can increase the avidity of the TCR interaction Ag:MHC complexes and, accordingly, are sometimes referred to as co-receptors.

In addition to the above-described classical MHC class I molecules (also known as "MHC class Ia" molecules), numerous non-classical MHC class I molecules (also known as "MHC class Ib" molecules) exist. MHC class Ib molecules. Some class Ib molecules, e.g., HLA-E in humans and H-2M3 bind peptide antigens, whereas others such as CD1 (cluster of differentiation-1) and MR1 (MHC-related protein-1) bind non-peptide antigens. Both $\alpha\beta$ and $\gamma\delta$ T cells recognize class Ib molecules (e.g., MR-1, HLA-G, or HLA-F, and others already mentioned above). Such T cells can be characterized as "unconventional," because they recognize lipids, metabolites, and modified peptides and produce innate immune cell-like rapid effector responses. Nonclassical class II molecules, HLA-DM and HLA-DO, are non-peptide binding class II MHC-II homologs, that function to edit the peptides presented by MHC class II molecules. Most, but not all, nonclassical MHC molecules have known interactions with T cells or NK cells. Biology of these and several other nonclassical MHC molecules, particularly CD1 molecules/processes, and associated T cell types (e.g., iNKT cells, dNKT cells, Gamma delta T cells ($\gamma\delta$ T cells), and the like) is discussed in, e.g., D'Souza M P et al. PLoS Pathog. 2019; 15(2):e1007567; Pereira C S et al. Immunity. J Immunol Res. 2016; 2016:2876275; Kaczmarek, R. et al. Arch. Immunol. Ther. Exp. 65, 201-214 (2017); Van Kaer L et al Trends Immunol. 2016; 37(11):738-754; Ulrichs T et al. Infect Immun. 2003; 71(6):3076-3087; and U.S. Pat. No. 7,063,844. In AOTI, a fusion protein of the invention will also or alternatively comprise one or more antigens that lead to effective non-classical MHC I Ag presentation. Expression of CD1 mediate peptides has been demonstrated in, e.g., Liu Y et al. J Clin Invest. 2011; 121(1):249-264 and Lee D J et al. J Exp Med. 1998; 187(3):433-438. In aspects, FPs comprise sequence(s) that promote/enhance synthesis of antigenic lipid(s), carbohydrate(s), or glycolipid(s) in TR(s), resulting in a non-classical MHC response. In other aspects, CEPESCs lack any non-classical MHC interacting EP ES(s).

In AOTI, T cell antigens of FP(s)/CEPs comprise, PC, GCO, or consist only of ≥1 TH (CD4+)/MHC II antigens, one or more CD8+/CTL/MHC I antigens, or a combination of one or more of each such type of T cell antigen.

T cell antigens in FPs/CEPs can be associated with DOS promotion or enhancement any suitable type of T cell Ag-associated IR(s). E.g., inclusion of 1+ T cell Ag(s) in FP(s) result in DOS increases in T cell production of interferon-$\gamma$ (IFN$\gamma$), transforming growth factor-$\beta$, IL-4, IL-5, IL-13, IL-17A, IL-17F, IL-21, IL-22 or CT. In AOTI, at least one T cell antigen of FPs or Ag EPs is an Ag that induces IR(s) in a regulatory T cell, a follicular T cell, or both. In AOTI, delivery of an effective amount of CEPESC (s) results in DOS higher number of epitope-specific $CD8^+$ T cells in a TR, cell, or population.

(a) MHC I/CD8+ Epitopes

In AOTI, FPs/CEPs comprise 1+ MHC I epitopes. As noted above, terms such as "MHC I" herein are meant to encompass all homologs of MHC I molecules present in a species (e.g., HLA in humans). In AOTI, OSMGAOA MHC I epitopes in FP(s) comprise a continuous (linear) AARS of about 8 to about 11 amino acids in length. In AOTI, the MHC I antigen detectably or significantly increases CD8+ T cell activity, such as CTL cytotoxicity. In AOTI, one, some, most, generally all, or all of the MHC I epitopes will bind one or more MHC I molecules with sufficient affinity to promote, induce, or enhance a MHC I-associated immune response (examples of suitable binding affinities for MHC I molecules and epitopes and related techniques/principles useful in the selection of Ag sequences and associated sequences are described in, e.g., Sette A et al. J Immunol. 1994 Dec. 15; 153(12):5586-92 and Berzofsky J A et al. Nat Rev Immunol. 2001 December; 1(3):209-19). In AOTI, one, some, most, generally all or all of the MHC I antigens of a fusion protein are associated with one or more PTPSs, such as one or more polyUb sequences. In AOTI, the inclusion of the PTPS detectably or significantly enhances the MHC I processing of one or more antigens of the fusion protein. In AOTI, the one or more NAMs comprising MHC I epitope-encoding sequences of a composition are associated with a transfection promoting agent, such as a calcium phosphate nanoparticle, which also or alternatively detectably or significantly enhances MHC I processing of one or more Ags encoded by such NAMs, MHC II processing of one or more such Ags, or both. In AOTI, FP(s) comprise ≥1 FP(s) comprising MHC I Ags and one or more HVEM-binding sequences, such as one or more gD HVEM-biding fusion proteins comprising one or more MHC I epitopes, wherein the inclusion of the HVEM-binding sequence also or alternatively detectably or significantly enhances MHC I processing of some, most, or all of the associated MHC I Ags.

In AOTI, CEPESCs comprise NS(s) encoding ≥1 gDAgFP and ≥1 Ags optimized for expression in a HVEM-expressing host, and (a) the host is not CI immunosuppressed when the method is performed (e.g., the method is performed to provide an immunization effect in the host), (b) no CTL for SMGAOA of the Ags exist in the TR prior to administration, or (c) both situations exist in the host, wherein the administration of an EA of the CEPESC results in an effective MHC I response, such as a significant MHC I Ag-specific response to OSMGAOA of the encoded Ags. In one aspect, CEPESCs comprise TFA(s), such as a CaPNP, an ITICSTAP (e.g., an EAT-2 polypeptide), one or more Ag-associated PTPSs, or a combination of any or all thereof. In one such aspect, the MHC I response is DOS greater in whole or at an Ag-specific level as compared to a corresponding composition lacking such additional features.

FPs/CEPs can comprise one or more confirmed MHC I antigens, one or more predicted MHC I antigens, or a combination thereof (typically in combination with one more confirmed MHC II antigens, one or more predicted MHC II antigens, or both). In AOTI, one or more expected/predicted MHC I or MHC II antigens will be identified through one of the epitope identification methods described below. In AOTI, a predicted MHC I or MHC II antigen will comprise a portion of an antigenic protein or a protein from a disease-causing agent, which typically comprise one or more aromatic amino acid residues, e.g., one or more Phe or Trp residues, one or more Lys or Met residues, or both. In AOTI, a predicted MHI epitope comprises 1, 2, or 3 aromatic AAs (e.g., Phe residue or Phe or Trp residues) or 1+ Met/Lys residues, positioned within position 4, 5, 6, or a combination of any or all thereof, in an expected MHC I T cell epitope sequence (i.e., the predicted MHC I Ag will have a structure according to the formula Xaa(a)-Xaa4-Xaa5-Xaa6-Xaa(b), wherein Xaa(a) comprises 1-3 of any AAs, Xaa(b) comprises 2-5 of any AAs, and at least one of Xaa4, Xaa5, and Xaa6 (if not 2 or 3 thereof) are Trp, Phe, Met, or Lys.

In AOTI, FPs/CEPs will comprise one or more MHC I epitopes that are ≥11 AAs in length (non-canonical MHC I epitopes). Examples of such MHC I epitopes are KITA (SFE Josephs T M et al. *Biol Chem.* 2017; 398(9):1027-1036). In AOTI, FPs/CEPs comprise at least one MHC I antigen or predicted antigen of less than about 11 amino acid residues, at least one confirmed non-canonical MHC I epitope, or both. In AOTI, a fusion protein comprises at least one long predicted/known T cell antigen (a sequence of over 30, over 40, or over 50 amino acid residues), at least one short known/predicted antigen, or both. In AOTI, a fusion protein comprises a long predicted/known antigen and such antigen is processed through antigen cross-presentation. In AOTI, inclusion of a long antigen results in a detectably or significantly faster T cell response, enhanced dendritic cell processing of the fusion protein, or both. The observation of such responses and related principles, methods, and compositions are described in, e.g., Zhang H et al. J Biol Chem. 2009 Apr. 3; 284(14):9184-91; Rosalia R A et al. Eur J Immunol. 2013 October; 43(10):2554-65; and Rosario M et al. Eur J Immunol. 2010 July; 40(7):1973-84). Examples of larger Ag sequences, derived from viral ORFs and expected to comprise one or more T cell epitopes, are provided below. FPs comprising these and other Ags that induce MHC I cross-presentation are DEH.

In AOTI, FPs/CEPs comprise multiple MHC I antigens (e.g., at least 2, 3, 4, 5, 7, 8, 10, or more MHC I antigens), a composition will comprise nucleotide sequences encoding multiple MHC I antigens, or both, where such multiple MHC I antigens are sufficiently different from each other to be expected or are known to induce a different profile of immune response in different individuals of a population/species. For example, such antigens may exhibit less than about 60%, less than about 45%, less than about 33%, or less than about 20% identity to each other. In such an aspect, the inclusion of such multiple MHC I antigens can detectably or significantly result in a larger proportion of a population exhibiting an immune response to one, some, most, generally all, or all of the MHC I antigen sequences in the fusion protein.

In aspects, FPs/CEPs will comprise one or more promiscuous MHC I antigens (which detectably bind one or more types of MHC I molecules). In AOTI, the fusion protein will comprise one or more MHC I antigen "supermotifs" that bind a number of common MHC I molecules high affinity. Such supermotifs are known in the art (SFE Sydney J. et al. Immunol Today. 1996 June; 17(6):261-6; WO1997033602; and Tang Y, et al. Immunol Invest. 2003; 32(1-2):31-41. Prediction methods for identifying T cell antigen supermotifs also are known (SFE Doytchinova I A et al. Methods. 2004; 34(4):444-453. In AOTI, the fusion protein will comprise one or more promiscuous (or "universal" or "broad-range") epitopes, which bind to a substantial fraction of a particular class of MHC molecules in an animal species or population. Such epitopes also are known in the art (SFE U.S. Pat. Nos. 6,143,935; 6,143,517; 6,689,363, 8,168,201; as well as US20040258660 and US20020076416. Methods for the prediction of promiscuous MHC I epitopes, allowing for incorporation of putative promiscuous epitopes in FPs, also are known. SFE Waheed Y et al. Asian Pac J Trop Med. 2017; 10(8):760-764.; Subramanian N et al. Asian Pac J Cancer Prev. 2013; 14(7):4167-4175; Shehzadi A et al. Virol J. 2011; 8:55; & Dar H et al. Asian Pac J Trop Med. 2016; 9(9):844-850.

(b) MHC II/CD 4+ Epitopes

In aspects, FPs/CEPs comprise at least one MHC II T cell epitope. In AOTI, fusion proteins of the invention, such as gD:Ag fusion proteins, will comprise at least one MHC II antigen and at least one MHC I antigen. In AOTI, the MHC I and MHC II antigen of a fusion protein promote, induce, or enhance an immune response against the same disease-causing agent or type of disease-causing agent in a target species, subject, cell type, etc.

MHC II molecules typically are expressed only on the surface of antigen-presenting cells (macrophages, dendritic cells, and B cells). MHC II molecule presentation is typically the primary way in which exogenous antigens are presented to T cells. Typically, CD4+ T cells respond with immune cell proliferation, cytokine production, or both. Accordingly, a DOS exhibition of either or both IRs is a characteristic of FPs expressed by CEPESCs.

FPs/CEPs can include confirmed MHC II epitopes, putative MHC II epitopes, or a combination thereof. In AOTI, the fusion protein comprises one or more putative MHC II epitopes, which can be, e.g., predicted epitope sequences or larger antigenic sequences known or expected to give rise to an MHC II response. In AOTI, a putative MHC II epitope sequence is provided which is known or predicted to be a surface exposed antigen sequence. In AOTI, a putative MHC II epitope sequence AOA comprises a coiled secondary structure (methods of secondary structure prediction and assessment are KITA and DEH) or will lack any secondary structure. In AOTI, a putative MHC II epitope sequence comprises one or more aromatic amino acid residues, one or more residues selected from Lys and Met, or a combination of either thereof. Typically, such sequences and known MHC II Ag sequences are linear sequences. In AOTI, a MHC II antigen or putative MHC II antigen is known to be or comprises 1+ AAs associated with a neutralizing Ab epitope. In AOTI, a putative or known MHC II Ag has a relatively lower level of glycosylation (below average or significantly less than), other homologous amino acid sequences, or lacks any known glycosylation or potential glycosylation sites.

In AOTI, CEPs/FPs comprise multiple MHC II antigens, multiple putative MHC II antigens, or a combination thereof. In AOTI, FPs/CEPs will also or alternatively (typically also) comprise multiple MHC I antigens, multiple putative MHC I antigens, or a combination thereof. In AOTI, one, some, most, generally all, or all of such Ags are associated with (a) a linker sequence, e.g., a medium linker (of at least four residues, a flexible linker, a linker comprising a glycosylation site, a cleavable linker, a linker comprising a cleavage site (e.g., a 2A site), or a linker that comprises a combination of any or all such characteristics), (b) an intracellular targeting sequence (e.g., a PTPS, an ERTPS, or an exosome-targeting sequence, or a combination thereof, and In AOTI, at least one, some, most, or all of the Ags are associated with at least one PTPSs, such as at least one polyUb), or (c) both. In AOTI, such multi-MHC I antigen, MHC-II antigen, or MHC I and MHC II antigen fusion proteins induce DOS IR(s) in a larger proportion of a population of a species or exhibit a greater or significantly greater response in a population, which may be due to the variability of different MHC molecules in populations.

In aspects, a CEP/fusion protein comprises one or more promiscuous/universal MHC II epitopes, MHC II supermotifs, or both (knowledgeable readers will recognize that there can be overlaps between such sequences). In AOTI, a CEP/FP comprises one or more promiscuous MHC I epitopes or MHC I supermotifs and one or more promiscuous MHC II epitopes or supermotifs, or antigenic variants of either or both thereof. MHC II promiscuous epitopes and methods for predicting such epitopes are exemplified in, e.g., Kashyap M et al. Infect Genet Evol. 2017; 53:107-115; Grabowska A K et al. Int J Cancer. 2015; 136(1):212-224; and Rosa D S et al. Arch Immunol Ther Exp (Warsz). 2010; 58(2):121-130. MHC II supermotifs are exemplified in, e.g., Malcherek G et al. J Exp Med. 1995; 181(2):527-536; Sinigaglia F, et al. J Exp Med. 1995; 181(2):449-451; and Morse H C. Immunol Today. 1996; 17(1):47-48. In AOTI, FPs comprising one or more MHC I epitopes and MHC II epitopes will also result in a humoral response that is at least partially attributable to one or more of the T cell epitopes of the fusion protein. In aspects, CEPs/FPs lack any B-cell epitopes (BCEs) but still results in a DOS enhancement of a humoral response to the DCA associated with the T cell antigens in the fusion protein/CEP.

As noted already herein, in one aspect antigen(s) of CEP(s) are sized optimized to enhance MHC I, MHC II, or both MHC I and MHC II IR(s). Whole protein Ags have been, e.g., determined to be associated with slower, lower, or both slower and lower IR(s) than short epitope-sized Ag sequences and mid-sized epitope comprising sequences and mid-sized sequences have been demonstrated to produce enhanced, faster, or enhanced and faster immune responses in some contexts (e.g., an Ag sequence of about 15-60, about 15-45, about 15-30, about 20-50, about 20-45, about 20-40, or about 20-30. Such principles are described in, e.g., Rabu C et al. Oncoimmunology. 2019; 8(4):e1560919.

In still another aspect, FPs/CEPs comprise Ag(s) that comprise one or more overlapping epitopes. In AOTI, FPs/CEPs comprise an antigenic sequence that comprises overlapping MHC I and MHC II epitopes. Examples of such overlapping epitope sequences are known in the art (SFE Lohia N et al. Viral Immunol. 2014; 27(5):225-234; Bristol J A et al. Cell Immunol. 2000; 205(2):73-83; and Fayolle C, et al. J Immunol. 1991; 147(12):4069-4073).

Various AOTI comprise particular types of Ags being contained in FPs/CEPs. Description of the use of antigenic sequences provides implicit support for the Ags in compositions and vice versa.

(c) Cross-Presentation Facilitating TEs

In AOTI, FPs/CEPS comprise one or more MHC II antigens that are also or alternatively cross-presented as MHC I antigens. In AOTI, FP EPS comprise one or more DCRTSs. In AOTI, such a fusion protein comprises one or more DCRTSs that target plasmacytoid dendritic cells, conventional dendritic cells (CDC1 cells, CDC2 cells, or both), or both types of DCs. In AOTI, such a fusion protein binds DEC-205. In AOTI, such a fusion protein is a DEC-205-binding multimeric trap comprising multiple Ag containing polypeptide monomers. In AOTI, the DCRTS also or alternatively targets CD40, CD11c, or both. In AOTI, such a fusion protein does not bind DEC-205. In AOTI, such a fusion protein is significantly taken up and processed by CDC2 dendritic cells. In AOTI, a nucleotide sequence of a composition encoding such a fusion protein also encodes a co-stimulatory CD40L or other DC/T cell stimulatory factors, such as an ITII, e.g., an EAT-2 polypeptide. In AOTI, the cross-presenting T cell antigen results in a detectably or significant enhancement of an immune response against a disease-causing agent in one or more aspects. Principles and methods relating to the design of cross-presenting Ag constructs are provided in, e.g., Tan A C et al. Immunol Cell Biol. 2013 January; 91(1):96-104. Other elements for promoting cross-presentation of Ags adaptable to FP EPs, include incorporation of a phosphatidylserine-binding domain, described in US20190218260, and M1, which is a modified version of the superantigen streptococcal mitogenic exotoxin Z-2, described in Dickgreber N, et al. J Immunol. 2009; 182(3):1260-1269.

(d) TH-Type Specific TCEs

In aspects, CEPs comprise CD4 epitopes that are CB the type of CD4/TH T-cell IR they primarily induce. The abbreviations Th1 (T helper cell type 1) and Th2 (T helper cell type 2) T cells and such CD4 cells are KITA.

In aspects, OSMGAOA CD4 TCEs in CEPs are Th1 TCEs (in aspects, OSMGAOA TCEs are Th1 CD4 TCEs). In aspects, OSMGAOA CD4 TCEs are Th2 TCEs (in aspects OSMGAOA TCEs are Th2 TCEs). In aspects, OSMGAOA CD4 TCEs in CEPs are Th17 TCEs (in aspects, OSMGAOA TCEs in CEPs are Th17 TCEs). In aspects, CEPs comprise 1+, 2+, 3+, 4+, or 5+Th1 TCEs; 1+, 2+, 3+, 4+, or 5+Th2 TCEs; or 1+, 2+, 3+, 4+, or 5+Th17 TCEs (e.g., in aspects, CEPs comprise 1+Th1 TCE(s) and 1+Th2 TCE(s)). In aspects, OSMGAOA of such TCEs induce IRs against the same type of DCA or same DCA. In aspects, 1+ of such TCEs are contained in gDAgFP(s). In aspects, 2+Th1 TCEs, 2+Th2 TCEs, or CT are contained in gDAgFP(s). In aspects, CEPs comprise gDAgFP(s) comprising PE(s) comprising 1+Th1, 1+Th2, or 1+Th17 TCEs. In aspects, gDAgFP(s) in CEPs comprise 2+Th1, Th2, or Th17 TCEs. In aspects, gDAgFP(s) comprise 2+ of Th1, Th2, and Th17 TCEs. In aspects, gDAgFP(s) comprise a mix of 2+ of Th1, Th2, and Th17 TCEs, and ≥2 of at least one of such type(s) of TCEs. In aspects, such PEs comprise MSL(s), FL(s), or MSFL(s), or self-cleavage site(s). In aspects, 1+ of any such Th-type specific TCE(s) in CEPs are associated with ITS(s), such as PTPS(s), such as polyUb(s). In aspects, 1+, 2+, 3+, or more of such TCEs are AgVs, such as GSRAgVs. In aspects, OSMGAOA of such TCEs are anti-cancer TCEs. In aspects, OSMGAOA of such TCEs are anti-pathogen TCEs. In aspects, CEPs include Th17 TCE(s) & SMGAOA of the TCEs are anti-cancer TCEs or anti-fungal TCEs. In aspects, OSMGAOA CD4 TCEs/TCEs are Th2 TCEs and SMGAOA of such TCEs induce IRs against extracellular parasites, such as works/nematodes, such as helminth(s).

Methods of mapping/differentiating Th1, Th2, and Th17 epitopes are known in the art, as our constructs, such as PEs, that exhibit mixes of such epitopes. Examples of such methods and constructs that can be adapted to these aspects are described in, e.g., Tatsumi T et al. J Exp Med. 2002; 196(5):619-628; Cervi L, et al. J Immunol. 2004; 172(4):2016-2020; Satoh R et al. Microbiol Immunol. 2010; 54(12):726-733; Watt W C et al. Semin Immunopathol. 2017; 39(3):245-253; Tanaka M et al. Clin Cancer Res. 2011; 17(16):5392-5401; Fraser D G, et al. Immunogenetics. 2003; 55(7):508-514; Zhu F et al. 2005; 23(27):3572-3580; Li X et al. Intervirology. 2015; 58(6):403-412; Yin D et al. Immunol Lett. 2016; 175:1-7; Thema N et al. Mol Immunol. 2019; 107:106-114; Yu W et al. Microb Pathog. 2017; 112:30-37; Kuipers K et al. Infect Immun. 2017; 85(10):e00281-17; U.S. Pat. No. 9,795,661; and US20180170997. Such epitopes and methods can be incorporated/adapted into these aspects of the invention.

In methods, one or more steps are taken to enhance Th1, Th2, or Th17 IRs. In aspects, one or more steps are taken to control Ag levels in TRs to promote such IRs. E.g., low or high Ag dosages of low affinity TCEs can promote Th2 responses, whereas moderate Ag expression levels promote Th1 IRs. Low or high doses of high affinity TCEs can promote Th1 IRs and mid-level dosages of low affinity TCEs can promote Th2 IRs. These and other factors that can promote polarization towards one type of TH response are known (SFE Kaiko G E et al. Immunology. 2008; 123(3):326-338; Rogers P R et al. J Immunol. 2000; 164(6):2955-2963; Brandt K et al. Scand J Immunol. 2002; 56(6):572-579; and Rogers P R et al. J Immunol. 1999; 163(3):1205-1213.

In aspects, methods comprise delivery of cytokines or cytokine-expressing NAMs to TRs to promote Th-specific IRs. In aspects, IL-12, IFN PPTs, IL-18, II-27, CD80, ICAM-1, or combinations are delivered to promote Th1 IRs (either as PPTs or via NAMs comprising related coding sequence(s)). In aspects, IL-4, IL-6, IL-11, CD2, CD86, or combinations are delivered/expressed to promote Th2 IRs. In aspects, protein kinase C (PKC) and calcium levels are modulated to promote Th1 or Th2 IRs. In aspects, calcineurin inhibitor(s) are administered/expressed to promote Th2 IRs. In aspects, IL-6 or TGF-β is/are expressed or delivered to promote Th17 IRs (in aspects, IL-23 also or alternatively is administered/expressed to promote Th17 IRs). In aspects, inhibitors of cathepsin B are administered/expressed to promote Th1 IRs. More generally, known factors that promote Th-specific responses are administered with related TH specific TCE(s). In aspects, MHC II trafficking signal(s) are delivered with Th1/Th2 TCEs (see WO2019071032).

In methods, two or more different CEPESCs are administered to TRs, in one of which the CD4 TCEs or TCEs PCGCOSCO or CO Th1 TCEs against a DCA or group of related DCAs, and at least one other of which the CD4 TCEs or TCEs PCGCOSCO or CO Th2 TCEs against a DCA or group of related DCAs. In aspects, delivery of the second CEPESC(s) in such a method is an optional step, depending on CEs in the TR(s) receiving the first CEPESC(s). In aspects, such methods are used to treat cancer & one/both reduce tumors.

In aspects, CEPs comprise 1+ or 2+Th2 TCEs and IRs comprise DOS enhanced production of IL-4, IL-5, IL-6, IL-10, or IL-13, or combinations. In aspects, CEPs comprise 1+ or 2+Th1 TCEs and IRs comprise DOS enhanced IFNg expression, IL-2 expression, or both. In aspects, the delivery of a particular TH epitope type DOS enhances the level of memory T cells of that TH type in TRs (e.g., Th1 TCE CEPs DOS enhance related Th1 memory cells).

In aspects, CEPs PCGCOSCO or CO Th1 TCEs comprise or are AAW toll like receptor (TLR) modulators that induce IRs. In aspects, CEPs PCGCOSCO or CO Th2 TCES comprise or are AAW PRR modulators.

2) B Cell Epitope Characteristics and BC ICRs

In AOTI, FPs/CEPs AOA comprises BCE(s). B cell epitopes contained in FPs/CEPs can be any suitable 1+ BCE(s). In AOTI, FP(s)/CEPs comprise 2+ BCEs. In AOTI, BCEs comprise linear B cell epitope(s). In aspects, BCEs of CEPs PC, SCO, or CO linear BCEs. In AOTI, CEP(s) comprise 1+ or 2+ non-linear/conformational (discontinuous) B cell epitopes.

In AOTI, CEPs comprise no known B cell epitopes. As discussed further below, in one aspect potential B cell epitopes of EP(s) are minimized through one or more modifications to the AARS thereof, such as through removal of one or more potential/known glycosylation sites from the antigen sequences, other functional sequences, or both. In aspects, EPs or CEPs lack BCEs but nonetheless DOS induce BC IR(s) in TR(s).

In AOTI, CEPESCs comprise 1+ putative B cell epitope-containing sequences. In AOTI, such a putative B cell antigenic sequence is from a surface exposed sequence, primarily comprises hydrophobic amino acids, or both. In another aspect such a putative B cell epitope also or alternatively reflects a predicted B cell epitope identified by 1+ BCE prediction methods, DEH.

3) Epitope Flanking Sequences

In AOTI, Ag AARS(s) comprise ½ flanking sequences that are positioned upstream or downstream of a known or predicted epitope, such as an MHC I epitope, MHC II epitope, or BCE. As noted, in one aspect an antigenic sequence is has a size that promotes an immune response, such as about 20-45, 20-40, or 20-35 amino acid residues. In one example, an antigenic sequence can comprise a core MHC I epitope of about 8-12 residues and an additional 10-30 amino acid residues. In another example, an antigenic sequence can comprise a core MHC II epitope of, e.g., 12-20 residues and about 5-25 flanking residues. In AOTI, the flanking sequences are identical or at least related (e.g., substantially identical or very related) to one or more native sequences flanking the antigen derived from the cognate protein of origin. Thus, for example, a fusion protein of the invention can comprise at least 2, 3, 4, 5, 6, 7, 8, 9, 10, 11, 12, 13, 14, 15, 16, 17, 18, 19, or 20 flanking residues, such as 2-30 flanking residues, 4-28 flanking residues, 4-24 flanking residues, or 5-20 flanking residues, which optionally are identical or substantially identical to corresponding flanking residues of the epitope or epitope-related sequence in a naturally occurring protein. In AOTI, the flanking residues are both upstream and downstream of the epitope. In AOTI, the presence of the flanking residues associated with an MHC II epitope detectably or significantly promotes MHC affinity, TCR recognition, or one or more aspects of the immune response. In AOTI, inclusion of flanking sequences of an MHC I epitope detectably or significantly enhances proteasomal processing, ER processing, T cell recognition, or any aspect of the immune response. In AOTI, an MHC I epitope sequence is about 20 amino acid residues or less. In AOTI, one or more antigenic sequences are at least about 20 amino acid residues. In AOTI, some, most, generally all, or all of the antigenic sequences of a fusion protein, encoded by nucleotide sequences of a composition, or both, are at least about 20 amino acids in length, such as between 20-100, between about 20-60, between about 20-45, or between about 20-35 amino acid residues in length. Related principles are described in, e.g., Luc Teyton. J Clin Invest. 2007; 117(11):3164-3166.

4) Polyepitope (PE) AARs/PPTs

As noted, in AOTI EPs (e.g., one or more gD:Ag fusion proteins) contain more than one Ag sequences, often three, four, five, six, seven, eight, ten or more separate and distinct Ag sequences (e.g., one or more gD:Ag fusion proteins can comprise 2-20, 2-16, 2-12, 2-10, 2-8, or 2-5 antigenic sequences, each of which comprising one or more epitopes). Such EPs can be described as "polyepitope" FPs. In AOTI, one, some, most, generally all, or all of the antigenic sequences of a polyepitope fusion protein are from different proteins of a DCA, different types of a DCA, or both. In AOTI, a polyepitope comprises two or more Ags that are non-heterologous. In one such aspect, such a polyepitope fusion protein can comprise two or more non-heterologous Ags that are associated with an induce an immune response against a single type of a DCA or a single DCA. Examples of DCAs are discussed further below. In AOTI, a polyepitope fusion protein comprises Ags against two or more types of DCAs. In AOTI, such Ags may be associated with different DCAs associated with a single disease (e.g., a cancer and a cancer-promoting virus, such as HPV). In AOTI, the polyepitope vaccine comprises one or more linkers (e.g., one or more mid-sized, flexible, or mid-sized and flexible linkers, such as GPGPG (SEQ ID NO:730), one or more intracellular targeting sequences (e.g., one or more PTPSs, such as one or more polyUb sequences), or both, associated with at least one, some, most, generally all, or all of the Ags in the polyepitope sequence. In AOTI, the polyepitope sequence comprises both MHC I and MHC II antigens. In AOTI, the polyepitope fusion protein detectably or significantly promotes, induces, or enhances CTL, Th, and B cell responses. In AOTI, the polyepitope comprises one or more variants of antigenic sequences ("antigenic variants"), such as variants in which glycosylation sites are removed. In AOTI, most, generally all, or all of the Ags are such variants.

Examples, techniques, and principles relating to polyepitope antigens that can in some aspects be applied to fusion proteins of the invention are described in, e.g., Zhang L. Cell Mol Immunol. 2018; 15(2):182-184; Thomson S A et al. J Immunol. 1996; 157(2):822-826; Smith S G. Curr Opin Mol Ther. 1999; 1(1):10-15; Suhrbier A. Immunol Cell Biol. 1997; 75(4):402-408; and Livingston B. et al. J Immunol. 2002; 168(11):5499-5506. Methods of designing polyepitope sequences also are being developed in the art and such methods can be applied to putative polyepitope fusion protein design (SFE Antonets D V et al. BMC Res Notes. 2013; 6:407. Published 2013 Oct. 10 and Patronov A et al. Open Biol. 2013; 3(1):120139.

5) Epitope Identification and Prediction

In AOTI, a fusion protein or the expression product can comprise one or more antigenic proteins with unidentified epitopes or one or more putative antigens (PAgs), e.g., one more amino acid sequences that are expected or predicted to comprise an MHC I epitope, MHC II epitope, B cell epitope, or combination of some or all thereof. Numerous methods and tools exist for identification of such epitopes exist in the art and, accordingly, only a limited, non-limiting list of exemplary principles and methods that can be used in the practice of the invention are described here.

At least three methods can be used to predict TCEs: (1) genetic methods, (2) motif prediction methods, and (3) immunoproteomic analysis methods. A putative TCE can be in one aspect identified by one, two, or all of these methods. In AOTI, a putative antigen is identified by immunoproteomic analysis. In AOTI, the putative antigen is a putative cancer antigen.

In a genetic approach, cDNA generated from one or more DCAs, such as one or more tumor cells, is introduced into APCs, resulting in their presentation in MHC molecules. Such methods are well known and have been practiced successfully for at least three decades. However, because such methods can lead to overestimation of antigenicity, or false negatives due to differences in cellular properties and processing of such sequences, such a method is in some respects combined with one or more other approaches in identifying putative epitope sequences for inclusion in a FP or EP.

A variety of immunoproteomic methods also are known in the art and any suitable immunoproteomic method or combination of such methods can be used to identify putative antigens. In AOTI, a putative antigen is also or alternatively identified through MHC molecule binding screening. For example, one or several overlapping synthetic peptides, which can for example span the entire sequence of an antigen of interest, can be screened for binding to MHC molecules, such as MHC II molecules. Screening may involve biophysical methods to measure MHC binding, T cell readout assays, or tetramer-guided epitope mapping. In AOTI, MHC-peptide complexes are isolated, bound peptides are eluted from the MHC molecules and analyzed by high-performance liquid chromatography (HPLC) fractionation, mass spectrometry, or both techniques. Quantitative mass spectrometry methods also or alternatively can be used to identify T cell epitopes. SFE Birkir Reynisson et al bioRxiv preprint.

Motif prediction uses algorithms to estimate how well peptides will bind to MHC molecules. These algorithms typically are based on patterns obtained from peptides known to bind MHC molecules with scores being assessed by evaluating specific anchor residues between the peptide and MHC binding groove. Motif prediction can have limited rates of success (in terms of false negatives, false positives, or both, particularly with hidden/subdominant epitopes). Such predictions can be improved by combining such analysis with other data points. For example, prediction can be further honed by examining potential proteasomal cleavage events in the parent protein. In AOTI, such a method is performed for MHC I epitope prediction, which tends to have a higher rate of success in computational approaches due to the better-defined pockets of MHC I molecules. Tools that currently are publicly available for such analysis include PREDIVAC; Rankpep; PEPVAC; SYFPEITHI; Vaxign; MHCPred; EpiTOP; TEPITOPE; EpiJen; Propred; and Propred-1. Methods and principles relevant to TCE prediction/identification are further described in, e.g., Sanchez-Trincado J L et al. *J Immunol Res.* 2017; 2017:2680160; Sadegh-Nasseri S. A. F1000Res. 2016; 5:F1000 Faculty Rev-1305; Comber J D, et al. Ther Adv Vaccines. 2014; 2(3):77-89; Zhao L et al., Hum Vaccin Immunother. 2013 December; 9(12):2566-77; and Mettu R R et al. 2016; 432:72-81. In AOTI, such methods are applied to the identification/selection of putative TCEs for inclusion in CEPs/FPs.

Experimental and in silico methods for BCE identification also are KITA and can similarly be applied to sequences to similarly help qualify/limit potential/putative BCEs (sequential/linear, conformational, or both). Wet lab methods can be directly analytical or functional, similar to methods employed in T cell epitope analysis and often methods described in connection with one type of epitope identification can be modified to identify epitopes of the other type.

In AOTI, X-ray crystallography is applied, typically to an Ag:Antibody ("Ab") complex, revealing conformational or linear B cell epitopes. Nuclear magnetic resonance (NMR) can similarly reveal information about the structure, dynamics, and binding energy of some Ag-Ab complexes. Electron microscopy (EM) or cryoelectron microscopy can also be used for epitope localization in some Ab:Ag complexes. Mass spectrometry methods also or alternatively can be applied to such complexes (e.g., limited proteolysis mass spec methods or epitope excision MS methods). The performance, and the strengths and limitations of NMR, EM/CM, MS, and crystallography methods for protein characterization are known and briefly discussed elsewhere herein.

Functional methods also can be used to map or aid in mapping potential B cell epitopes. Many methods for B cell epitope mapping can be divided into four main groups: competition methods, antigen fragmentation methods, modification methods, and methods using synthetic peptides or peptide libraries. Competition methods involve the use of multiple antibodies ("Abs") against a particular target, to identify Abs that bind to the same epitope. Such methods are usually more helpful in identifying useful Abs, rather than in epitope mapping. Most functional epitope mapping methods are based on the ability to detect binding of antibody to antigen fragments, synthetic peptides, or recombinant antigens (including mutated variants, antigens arrayed by in situ cell-free translation, and/or expressed using selectable systems such as phage display). In typical binding assays, peptides are immobilized on solid support and binding of antibody is detected by western blot, dot blot, and/or ELISA (e.g., with peptide microarrays). Mutagenesis methods also can be applied to identify residues that make up part of an epitope (e.g., by substituting likely hot spot residues Tyr, Ag, and Trp with other residues, e.g., Ala or Gly, by other site-specific mutagenesis methods, by saturation mutagenesis, alanine mutagenesis, or any other suitable random mutagenesis technique). Such methods often involve display technologies, such as phage or yeast display methods.

A variety of computational approaches for B cell epitope identification also are available and can also or alternatively be used to identify/characterize putative B cell epitope sequences for inclusion in a gD:Ag fusion protein or other expression product. B-cell epitope databases include multi-faceted database such as IEDB and AntiJen, B-cell oriented database such as BciPep, Epitome, and SDAP, and single pathogenic organism oriented database such as the HIV Molecular Immunology Database, FLAVIdB, and Influenza Sequence and Epitope Database. Examples of tools for continuous BCE prediction based on such databases & other predictive algorithms/methods include ABCPred; BepiPred; LBtope; IEDB; & SVMTriP. Tools available for conformational B cell epitope prediction, sometimes based on structural information (PDB/PDB ID files), include DiscoTope; BePro; Ellipro; Epitopia; EpiPred; PEASE; and CBTOPE. Bioinformatics tools for conformational B-cell epitope prediction using mimotopes include PEPITOPE and MIMOX. Other approaches are based on the Kolaskar and Tongaonkar scale, such as the methods implemented by the commercially available GCG and EMBOSS packages. These various approaches and related PMCs are described in, e.g., Sanchez-Trincado J L et al. J Immunol Res. 2017; 2017: 2680160; Potocnakova L et al. *J Immunol Res.* 2016; 2016: 6760830; Haste Andersen P et al. *Protein Sci.* 2006; 15(11): 2558-2567; & Cangzhi Jia et al. Current Bioinformatics. Vol 14, Iss. 3, 2019. Any one or combination of such approaches can be applied to identify/characterize putative BCEs.

From the preceding paragraphs it will be clear that the invention also provides methods of screening antigens for development of gD:Ag fusion protein-encoding constructs and related compositions expressing various expression products. For example, one such method can comprise (a) providing a number of putative Ag sequences; (b) subjecting the putative Ag sequences to one, two, three, or more of the above-described analytical methods and selecting sequences with favorable results from such one, two, three or more methods; (c) preparing nucleotide sequences encoding such putative Ags and incorporating such sequences into a composition of the invention to be expressed in a gD:Ag fusion protein or other expression product expressed with a gD:Ag fusion protein. In AOTI, some, most, or all of the putative Ag amino acid sequences are mid length sequences (e.g., about 25-45 or 25-30 residues in length); the putative Ag amino acid sequences comprise putative MHC I and MHC II Ags; the putative Ag amino acid sequences are expressed with one or more known Ag sequences; the method comprises modifying the putative Ag to obtain an editope or Ag variant (such as a deglycosylation variant); one some or all of the putative Ags are associated with an intracellular TS, such as a PTPS (e.g., a polyUb); or the putative Ag expression products are expressed with an ITII. Such methods can comprise iterative testing of putative Ags, testing of putative gD:Ag fusion protein-expressing compositions in vitro or in vivo; and any suitable CT.

b. Epitope Types

In aspects, ≥1 epitopes of EPs can also or alternatively be characterized on the relative functionality of the epitope (e.g., antigenicity of the epitope), recognition of the epitope by the immune system, composition of the epitope, or a combination of any or all of such factors.

1) Immunodominant/Subdominant Epitopes

In AOTI, CEPs/EPs, e.g., gDAgFPs comprise at least one immunodominant epitope, at least one subdominant epitope, or a combination thereof. The concept of immunodominance is understood, and thus only briefly discussed herein in a non-limiting manner. Typically, an "immunodominant" epitope refers to an epitope that is most easily recognized by the immune system and thus most influence the specificity of an immune response to a composition comprising multiple epitopes in addition to the immunodominant epitopes. In general, immune responses are mounted against only a few of the antigenic peptides out of the many produced. Epitopes that are not targeted or targeted to a lower degree during an immune response are known as "subdominant epitopes." The impact of immunodominance in epitopes is "immunodomination," where immunodominant epitopes can curtail immune responses against non-dominant epitopes. Thus, Ags associated with a particular DCA are typically of variable immunogenicity, with the Ag stimulating the strongest response being the immunodominant Ag. The term also applies to immune cells that respond to an Ag, as such cells will typically reproduce faster and in more significant numbers, thereby dominating the immune response to antigens present in the subject or milieu. For example, T cells with a TCR that has high affinity for its antigen are most likely to be immunodominant. Similarly, if a B cell epitope binds very strongly to a B cell BCR, it will then subsequently bind with high affinity to the resultant antibodies produced by that B cell upon activation and such antibodies will out-compete any other BCR for the epitope, limiting the population of B cells.

Immunodominance is both a complex phenomenon and a relative term. Often If subdominant epitopes are introduced without the dominant epitope, the immune response will be focused to that subdominant epitope. Immunodominance typically is primarily dictated by the epitope sequence of an Ag but can vary depending on factors including simultaneous processing of multiple proteins, involvement of multiple alleles of MHC II that can bind to the same antigen, liberation of peptide (in the case of MHC I epitopes), transport of the protein to correct organelles, survival of proteolytic and other degradation processes, availability of immune cells, genetic make-up of a host (e.g., HLA-B8, DR3, DQw2a individuals are low responders to HBV Ags) and competition among several suitable epitopes on a single protein antigen. There is some evidence that flanking sequences can also influence at least T cell epitope immunodominance (Le Gall S et al. J Clin Invest. 2007; 117(11): 3563-3575) and modification of flanking sequences to enhance or reduce immunodominance effects can be employed in the design of expression products herein. At least with respect to MHC II epitopes position of the epitope also can matter as epitopes associated with quicker MHC II binding may be more likely to survive proteolysis and thus present more effectively, making MHC II epitopes located near N or C termini of sequences, proteolytic sites, or both, often more effective (accordingly, In AOTI, a fusion protein or expression product of the invention comprises one, two, or more MHC II epitopes that are characterizable in being (a) positioned in or near (e.g., within 25 residues or less, 15 residues or less, or 5 residues or less) of the N terminus, C terminus, or both N- and C-termini of an antigenic sequence portion of an expression product or (b) associated one or more cleavage sites, such as 1+2A SCSs.

Immunodominance also is not always restricted to just one Ag/epitope or cell type and does not always result in complete silencing of immune responses to subdominant epitopes. Levels of immunogenicity amongst antigens forms what is known as "dominance hierarchy" or "immunodominance hierarchy." The position of an epitope within the immunodominance hierarchy can be relevant to the associated immune response. In AOTI, it can be useful that at least one, some, most, generally all, or all of the Ags of an expression product, such as an gDAgFP, are immunodominant. However, in aspects, it is beneficial to present only, generally only, mostly, some, or at least one immunodominant epitope. For example, in one aspect a gDAgFP is provided that comprises, PC, or only comprises epitopes that based on previous studies were considered subdominant epitopes of an Ag, wherein inclusion of the subdominant epitopes results in DOS reduced Ag immune tolerance, prolongs the immune effect associated with the subdominant Ag, increases the proportion of subjects that exhibit a clinically relevant response to the gDAgFP, or a combination thereof.

In one aspect an "immunodominant" epitope is an epitope that in a particular context was associated with a significantly larger proportion of an IR than most, generally all, or all known Ags to be expressed, administered, or present, and at least about 30% (e.g., at least about 50%, at least about 65%, at least about 75%, at least about 80%, or at least about 90%) of the overall IR (e.g., as measured by a sampling of Ag-specific adaptive immune cells). In such an aspect, a subdominant epitope will be associated with less than 30% of the relevant immune response, such as less than about 20%, less than about 15%, less than about 10%, or less than about 5% of the immune response of the expressed, administered, or known Ags in the subject/milieu.

In AOTI, CEPs comprise only one MHC I epitope, only one MHC II epitope, or only one of each such type of T cell epitope (optionally wherein the MHC I Ag is associated with one or more PTPSs or other intracellular TSs, the construct comprises an expression-enhancing intron, the nucleotide sequences of the composition encode an ITII, such as an EAT-2 polypeptide, the construct is associated with CaPNP, or a combination of some or all thereof). The invention provides a corresponding method that comprises administering such a construct initially to a host as a priming immunomodulation event, following by boosting with such Ags, such Ags plus other Ags, other Ags from the DCA or that are variants thereof, such a fusion protein, or other gDAgFP fusion proteins, or a combination of such factors, wherein such a prime/boost method results in a detectable or significant response against more Ags; less silencing of immune responses against subdominant Ags expressed in the prime step, boost step, or both steps; or a clinically significant improvement in outcomes in an individual or population. In one such aspect, the MHC I Ag is known to not result in cross-presentation. In one case, the MHC I Ag does not detectably or significantly result in cross presentation and the MHC I Ag is associated with one or more detectably or significantly enhanced CD8 responses.

In AOTI, the immune response elicited by the methods and compositions provided herein comprises an immune response to at least one subdominant epitope. In another embodiment, the immune response does not comprise an immune response to a subdominant epitope. In another embodiment, the immune response consists primarily of an immune response to at least one subdominant epitope. In another embodiment, the only measurable component of the immune response is an immune response to at least one subdominant epitope. Each type of immune response represents a separate embodiment of the present invention. In AOTI, an expression product comprises one or more overlapping epitope Ags, which are associated with a reduction in immunodominance and larger number of significant Ag-specific immune responses. In AOTI, the expression product of a composition of the invention comprises a mixture of both dominant and subdominant epitopes wherein the level of immunodominance is not significant enough to silence all, generally all, most, some, or at least one of the subdominant epitopes. Such compositions can result in a broader, more protective immune response as has been demonstrated in some studies (SFE Dominguez M R, et al. PLoS One. 2011; 6(7):e22011; Filskov J et al. J Virol. 2017; 91(14):e00130-17; Ascough, S et al. Frontiers in Microbiology, 6(JAN); and Ling Chen et al. Proceedings of the National Academy of Sciences March 2018, 115 (12) 3126-3131). In AOTI, a method of the invention comprises the delivery of different expression product-encoding compositions to a subject, each comprising different Ags related to a type of DCA or DCA, which results in a detectably broader (or significantly broader) immune response against more Ags than if such Ags were expressed from administration of a combined expression product or repeated expression from a single type of expression product.

Examples of both dominant and subdominant epitopes are known. For example, van der Most et al. describe dominant and subdominant epitopes of chronic lymphocytic choriomeningitis virus in J. Immunol. 1996 157:5543-54. For example, NP (118-126) is a dominant epitope and GP (35-43), GP (99-108), and GP (283-291) are subdominant epitopes (amino acid numbering according to van der Most and references therein). Subdominant and dominant epitopes of HIV-1 are described by Lichterfeld et al. in Trends in Immunology 2005 26:166-71; Corbet et al. J. Gen. Virol. 2003 84:2409-21; Santra et al. J. Immunol. 2002 168:1847-53; and Goulder et al. J. Exp. Med. 1997 185:1423-33. Subdominate epitopes of Epstein-Barr virus ("EBV") are described by Micheletti et al. Eur. J. Immunol. 1999 29:2579-89; and Duraiswamy et al. Can. Res. 2004 64:1483-89. Examples of dominant epitopes for EBV are provided by Hollsberg in Scand. J. Immunol. 2002 55:189-95. Bertoletti et al. describe dominant and subdominant epitopes of hepatitis B virus in J. Exp. Med. 1994 180:933-43. Examples of epitopes of hepatitis C virus are provided by Himoudi et al. in J. Virology 2002 76:12735-746. Immunodominance has also been recognized in association with the influenza virus, see for example Meijers et al. J. Mol. Biol. 2005 345:1099-1110. Protection against lethal viral infection by vaccination with subdominant peptides was demonstrated by Oukka et al. in J. Immunol. 1996 157:3039-45. Sendai virus epitopes are described by Cole et al. in Immunol. 1997 158:4301-09 and in J. Virology 1995 69:8057-8060. Busch and Pamer describe immunodominance in the context of *Listeria monocytogenes* infections in J. Immunol. 1998 160:4441-48. Taracha et al. provide examples of immunodominance in the vaccination of cattle against *Theileria parva* in J. Immunology 1995 155:4854-4890. Numerous examples of subdominant epitopes and methods for identification thereof are provided in U.S. Pat. No. 8,398,992. Additional relevant principles to identify, optimizing, selecting, and using immunodominant and subdominant epitopes are described in US20170065702A1; Sadegh-Nasseri S et al. Mol Immunol. 2019; 113:115-119; Kedl R M et al. Curr Opin Immunol. 2003; 15(1):120-127; Sette A et al. Curr Opin Immunol. 2003; 15(4):461-470; Mettu R R et al. J Immunol Methods. 2016; 432:72-81; Ritmahan W et al. Immunogenetics. 2020; 72(1-2):109-118; WO2015084986A1, and WO2004068135A2.

1) Cryptic & Unnatural Immunity Epitopes

In aspects, expression products, such as gDAgFPs, can comprise one more cryptic epitopes, unnatural immunity epitopes, or both types of epitopes. Cryptic epitopes are epitopes that are usually buried within the structure of a protein (also referred to as "neo-epitopes" or "masked epitopes"), but which may trigger the immune system once they become solvent-exposed, for example due to degradation, misfolding, or aggregation. Hydrophobic portions of biomolecules (so-called "hyppos"), can be associated with damage-associated molecular pattern that leads to innate immune responses once the hyppos become solvent-exposed (see for example Seong and Matzinger, Nature Reviews 2004, 469), and various examples of previously-buried hydrophobic patches triggering immune responses have been described in the art (see for example David et al., JBC, 2001, 6370-6377; Matsuura et al., International Immunology, 2000, 1183-1192; Rasheed et al., Life Sciences 79 (2000), 2320-2328). As such, in AOTI such epitopes are included in gDAgFPs or other EPs. Many cryptic epitopes are also subdominant epitopes, and the principles relating thereto can also be applicable to the present AOTI.

In aspects, an expression product, such as a gDAgFP, comprises one or more unnatural immunity epitopes. Unnatural immunity epitopes are epitopes that are associated with an immune response that occurs rarely or with low frequency in most hosts of a species. Unnatural immunity is described in Nabel G J, Fauci A S. Nat Med. 2010; 16(12): 1389-1391. Through applying proteolysis and antigen screening methods, such as those described elsewhere herein, putative unnatural immunity epitopes can be selected and confirmed unnatural immunity epitopes be identified, and in either case such antigenic/putative antigenic sequences can be incorporated into expression products.

c. Editopes and Antigen Variants

In AOTI, EP(s) comprise one or more variants of naturally occurring antigenic sequences ("antigenic variants" or "AVs"). In AOTI, one or more of such AVs comprise an editope. An "editope" is an AV that exhibits an enhanced immune response in at least one respect and in at least one or more contexts when expressed in a subject or immunocompetent immune cell composition. Expression products can comprise any suitable number of AVs/editopes, each of which being any suitable type of AV/editope (e.g., a gDAgFP can comprise at least one MHC I AV, at least one MHC II AV, or both).

In AOTI, EP(s) comprise at least one TCE that comprises a substitution that results in a detectably or significantly modified MHC binding affinity, such as enhanced MHC binding affinity, e.g., in a subdominant, cryptic, or poorly immunogenic epitope. In AOTI, such an editope comprises one or more substitutions in epitope anchor residues. Anchor residues are residues that disproportionately contribute to MHC binding. General characteristics of anchor residues are known (SFE Hobohm U et al. Eur J Immunol. 1993; 23(6):1271-1276; Chujoh Y et al. Tissue Antigens. 1998; 52(6):501-509) and anchor residues have been identified and modified in association with a number of DCAs (SFE Huang J et al. BMC Immunol. 2012; 13:50. Published 2012 Sep. 10 (SARS-COV); Dobaño C, et al. Mol Immunol. 2007; 44(9): 2235-2248 (malaria); Vierboom M P et al. J Immunother. 1998; 21(6):399-408 (HVP); and Gerner W et al. J Virol. 2009; 83(9):4039-4050 (foot and mouth disease). In AOTI, 1+ enhanced MHC binding editopes are provided in a polyepitope (PE) sequence, which optionally includes one or more intracellular TSs, such as PTPSs, one or more cleavage sites, and one or more linkers (e.g., MSLs, FLS, or MSFLs). Enhanced MHC affinity epitopes have been demonstrated in, e.g., Tine J A et al. Vaccine. 2005; 23(8):1085-1091; Hofmann S, et al. Cancer Immunol Immunother. 2015; 64(11): 1357-1367; and U.S. Pat. No. 7,605,227. In AOTI, the enhancement is with respect to binding a particular type of MHC, such as class II DR4. In AOTI, a dominant epitope is substituted with a less immunogenic editope in EP(s), particularly in a multi-Ag method or multi-Ag expression product, such as a multi-Ag gdAgFP, resulting in a detectably broader immune response, including a detectably or significantly enhanced IR to the other Ags in EP(s). Reduced immunogenicity editopes have been demonstrated by, e.g., Ruckwardt T J et al. J Immunol. 2010; 185(8):4673-4680. Other principles relative to modification of editopes impacting the dominance hierarchy are described in, e.g., Sadegh-Nasseri S et al. Mol Immunol. 2019; 113:115-119.

In AOTI, editope(s) of EP(s) are formed by generating consensus sequences from antigen homologs (intraspecies, interspecies, or both). Examples of such approaches are described in, e.g., US20190161519; Chen M W et al. Proc Natl Acad Sci USA. 2011; 108(9):3510-3515; and Walters J N et al. Mol Ther. 2017; 25(4):976-988. In aspects, an editope is designed based on patterns of epitopes associated with antigenicity, such as the pattern descried in WO2012076708. In AOTI, an editope comprises one or more modifications that result in the removal of one or more Cys residues or confirmed removal of one or more disulfide bonds from the Ag, and which thereby detectably enhances antigenicity. Such a strategy is described in, e.g., US20150037371 and Shi W et al. J Virol. 1999; 73(9):7877-7881. Editopes and putative editopes for incorporation in expression products also can be generated through mutation methods, directed evolution methods, and the like described elsewhere herein (see also, e.g., Konar M et al. PLoS One. 2015; 10(6):e0128185). Such methods are relevant to methods of screening putative editope constructs which are provided by the invention. Other editopes comprise introduction of post translational modification sites, such as glycosylation sites, fusion with an immunomodulatory sequence (e.g., a PRR agonist/PAMP sequence, or both (these and other are approaches are reviewed in Saylor K et al. Front Immunol. 2020; 11:283. Published 2020 Feb. 24) and exemplified in US20180179256. In still another aspect, an editope can comprise modifications that also or alternatively enhance Ag stability, often also leading to detectably enhanced immune responses (such an approach is exemplified by, e.g., Thomas J C et al. Hum Vaccin Immunother. 2013; 9(4):744-752). Other editopes are also or alternatively designed to have a reduced tolerogenic profile (SFE Berzofsky J A, et al. Cancer Immunol Immunother. 2018; 67(12):1863-1869 and Konar M et al. PNAS 2015; 112(48): 14823-14828). Editopes having any such characteristics described in this section can be incorporated into EPs.

Another type of editope that can be in EPs is an editope in which AAs have been substituted with a modified residue or residue outside of the naturally occurring residues. Such aspects are typically limited to polypeptide product methods and compositions, with limited exceptions, as discussed elsewhere herein. In one such aspect, the inclusion of an unusual or modified amino acid residue detectably prolongs the onset of tolerance to the editope as compared to the corresponding unmodified Ag, reduces the frequency of tolerance, reduces the severity of tolerance, or a combination of any or all thereof. An example of such an approach is exemplified in U.S. Pat. No. 8,318,172.

In AOTI, an editope in EP(s) is formed by modifying one or more immunodominant non-protective epitopes (IDNPEs, which also include epitopes that stimulate strain-specific, but less broad immunity). Changes to such an IDNPE can induce a new hierarchy of immune responses at either or both the B and T cell levels (SFE Garrity et al., J. Immunol. (1997) 159(1):279-89) against subdominant or previously silent epitopes. Such methods are often referred to as "immune refocusing" methods.

1) Deimmunization Variations (DIVs)

In aspects, Ag(s) or other AARS(s) of EP(s) comprise variations that DOS reduce the immunogenicity of the AARS in TR(s). Numerous strategies for deimmunization of AARS(s) are known and at a general level such variations are not limited to the methods described here. Any AARS in a CEP can comprise any suitable number and type of deimmunization variations. Suitable deimmunized variants (DIVs) exhibit suitable, comparable, or enhanced functionality. Although CEP(s) comprise Ag(s) and are desirably immunogenic, undesired immunogenicity can diminish antigenic IR(s) in TR(s) and can interfere with the transport of EPs and functioning of non-Ag EPs/AARSs in TR(s), such as RBDs, ITII(s), NANCIPI(s), CM(s) (e.g., CI(s)), etc. Accordingly, in aspects, OSMOA AARSs in EPs comprise DIV(s). In aspects, OSMOA undesirable epitopes in WT AARSs of EPs are subject to substitutions, deletions, combinations, etc., resulting in functional DIVs. Also, WT Ag(s) can include undesirable epitopes, such as decoy antigens, overlapping epitopes, undesirable levels of immunodominance, undesirable levels of Th2/Th17 responses, or undesirable BCE(s), which can undesirably reduce effectiveness or induce AE(s). In aspects, OSMOA of epitopes associated with OSMOA of such effects are eliminated or modified. In aspects, DIV(s) in EP(s) DOS reduce anti-biotherapeutic immune response(s) associated with WT AARS(s) or that arise from fusion of non-homologous AARS(s) (aBIR(s)).

In aspects, DIVs are generated through "humanization" and similar TR-based DIV strategies in which AARS(s) that potentially are not recognized as self in a TR (e.g., a human) are modified to be recognized as "self" AARS(s). Humanization of PPTs, especially Abs is well known (SFE Jones et al., Nature 321:522-525 (1986); Riechmann et al., Nature 332:323-327 (1988); and Verhoeyen, et al., Science, 239: 1534-1536 (1988)) and such methods can be adapted to non-Ab AARS(s) in EP(s). More "self-like" (e.g., human-like) AARSs can be obtained by other variation methods, such as DNA shuffling (exemplified by, e.g., Chen J, et al. Int J Biol Macromol. 2016 January; 82:522-9).

In aspects, TCE DIV(s) comprise substitutions or deletions that eliminate undesired TCE(s) or that DOS reduce undesired immunogenicity of DIVs. In aspects, TCE DIS(s) exhibit DOS reduced binding to MHC(s). TCE DIV(s) and other DIV(s) can be generated by experimental methods (e.g., ELI screening), computational methods, and combinations. In general, critical MHC binding residues are deleted or substituted to generate such TCE DIV(s) (which typically are no longer TCE(s)). In aspects, hydrophobic AAs, aromatic AAs, in an epitope or predicted epitope are removed and the putative DIV tested for reduced immunogenicity. Such methods can include computational or experimentational assessments of changes in structure, function, or both (e.g., receptor-binding ability). In aspects, structure of a DIV-associated PPT is similar (e.g., as evaluated by structure similarity methods provided herein); function(s) of AARS(s) in the PPT are suitable, comparable, or enhanced; or both, and the immunogenicity of the DIV PPT is DOS reduced. Such approaches have been successfully applied to functional PPTs, such as staphylokinase (Warmerdam P A, et al. Thromb Haemost. 2002 April; 87(4):666-73); erythropoietin (Tangri et al., J Immunol. 2005 Mar. 15; 174(6): 3187-96); and Factor VIII (initial variant with 75% activity and partial deimmunization described in Pratt K P, Cell Immunol. 2016 March; 301:12-7 and variant with comparable functioning and further improved deimmunization (and related strategy) described in Jankowski W et al. Blood Adv. 2019; 3(17):2668-2678). Tools for identifying potential immunological active regions of PPTs and recommending modifications are available in the art (e.g., the IEDB deimmunization tool). Applying such analysis to, e.g., BHV-1 gD, identifies an immunogenic sequence at AAs 155-169 of iBHV-1 gD (SEQ ID NO:646) and possible variations thereof, e.g., FVs at AA M-173, e.g., DDELGL PMAAPARLV (SEQ ID NO:647), DDELGLGMAAPARLV (SEQ ID NO:648), and DDELGLDMAAPARLV (SEQ ID NO:649) that are predicted to be less immunogenic. Applying the same method to murine EAT-2 (mEAT-2), identifies the sequence at AAs 91-105 (QGLVVHLSNPIMRNN (SEQ ID NO:650)) as immunogenic and recommends variations at the $2^{nd}$ Val, $2^{nd}$ Leu, or Met of the AARS (e.g., QGLV DHLSNPIMRNN (SEQ ID NO:651), QGLVVHLSNP DMRNN (SEQ ID NO:652), or QGLVVHDSNPIMRNN (SEQ ID NO:653) to reduce IR(s).

Another type of DIV is a de-immunodominance DIV (DEDIV). DEDIV(s) comprise modifications that reduce the immunodominant effects of a BCE or TCE. Immunodominance and such variations are further discussed below. Briefly, DEDIVs reduce immunodominance that can block other subdominant epitopes (e.g., cryptic TCEs). The ability of such DIV(s) to increase Ag-specific IR(s) in PE and multi-Ag compositions has been demonstrated in respiratory syncytial virus epitopes (Ruckwardt T J, et al. J Immunol. 2010; 185(8):4673-4680 and T. cruzi (Dominguez M R, et al. PLoS One. 2011; 6(7):e22011). Such DIV(s) can be used in CEP(s) and such methods can be adapted to use with other Ag(s) described here.

In aspects, immunodominance is enhanced or reduced in EP(s) through the use or non-use of ITS(s). E.g., an Ag can be directed to an exosome over an immunoproteasome to reduce immunodominance in some aspects, or an Ag can be directed to an immunoproteasome to enhance immunodominance. As exemplified by this statement in some aspects, immunodominance of Ag(s) are enhanced in AgV(s). In some aspects, CEP(s) comprise only one immunodominant Ag, such as an immunodominance-enhanced AgV. Such methods are exemplified in, e.g., Dzutsev A H et al. Int Immunol. 2007; 19(4):497-507. In aspects, enhanced MHC affinity of TCEs results in lower immunogenicity of PPTs (Id).

Immunodominance also can be modulated through controlling Ag expression levels. In aspects, immunodominant epitopes, such as immunodominant TCE(S) are modified, excluded, expressed in lower amounts, etc., to ensure SMOA Ag(s) in CEPs induce IR(s).

In aspects, SMOA of the Ag(s) in multi-Ag CEPs (e.g., in PE CEPs) are screened, selected, or determined to not result in an undue immunodominance effect that blocks SMOA of the other Ag(s) in the CEP inducing DOS IR(s) (such a PE is exemplified in, e.g., Cho H I, et al. Cancer Immunol Immunother. 2012; 61(3):343-351). In aspects TCEs/BCEs exhibit DOS immunodominance hierarchy in a TR.

In aspects, immunodominance or immunogenicity is blocked in a DIV, i.a., by introduction of modifications (e.g., cys-cys bridges) that block access to an epitope (exemplified in Rouvinski A et al. Nat Commun. 2017; 8:15411. Published 2017 May 23). In aspects, epitope immunodominance or immunogenicity is modified by elimination of a domain (e.g., the HA head of influenza), unmasking subdominant epitopes (e.g., through removal of glycosylation sites, cys-cys bridges, and the like), or enhancing immunogenicity of a subdominant epitope (e.g., through hyperglycosylating a BCE, enhancing MHC binding in a TCE, or combining part of an epitope with other AARS(s), such as in a chimeric epitope. Such approaches are reviewed in, e.g., Mathew N R, Front Immunol. 2020; 10:2997.

In aspects, an immunodominant epitope is substituted with a mimetic with reduced immunodominance effects. This approach is exemplified in de Taeye S W et al. J Biol Chem. 2018; 293(5):1688-1701. In aspects, increasing the diversity of epitopes in a CEP reduces immunodominance (SFE Woodruff M C et al. Cell Rep. 2018; 25(2):321-327.e3).

Other examples/approaches for reduced immunodominance that can be adapted to EPs are described in Kim A et al. Curr Opin Immunol. 2015; 34:9-15 and Liu et al. J Immunol. 1993; 151(4):1852-1858. Similar and other methods, principles, and compositions are DEH WRT immunodominant and subdominant epitopes, generally. Such methods can be combined with, substituted by, or substitute any methods described in this section and vice versa.

In AOTI, DIV(s) at a PPT level comprise adding regulatory T cell (Treg) epitope(s) (TREGE(s)) to EPs, which reduce EP IR(s). In aspects, no TREGEs are present. In AOTI, TREGE(s) in EP(s) are removed or the effect of TREGEs (e.g., MHC binding) is reduced.

In method aspects, TR(s) can be subjected to methods that induce partial tolerance to PPTs to reduce immunogenicity or to reduce the immunodominant effects of potentially immunodominant epitopes. Such approaches are exemplified by, e.g., Silva M, et al. Cell Rep. 2017; 21(13):3672-3680.

In aspects, CEPs comprise IL-10 PPTs (isolated or FPs). In AOTI, IL-10 PPTs in CEPs DOS reduce immunodominance effects of OSMOA potentially immunodominant epitope(s) in CEPs (such IL-10 effects are covered in St Leger A J, J Immunol. 2013; 191(5):2258-2265).

In aspects, flanking sequences of epitopes are modified to modulate immunodominance. Such an approach is discussed in, e.g., Mo A X, et al. J Immunol. 2000; 164(8):4003-4010.

In aspects, full PPT Ag(s) or Ag(s) significantly larger than epitope(s) are incorporated in CEPs, but comprise fragments of full-length PPT Ag(s), resulting in immunodominance reduction. SFE Liu Y et al. Vaccine. 2011; 29(14):2582-2589.

Services for the design of DIVs are commercially available, such as EpiVax DeFT™ service (epivax.com/deimmunization), the RDIT® De-immunization Services available from Creative Biolabs (creative-biolabs.com/De-immunogenicity-De-immunization), and the Protein deimmunization platform services available from Abzena (abzena.com/development-services/protein-engineering/protein-deimmunization/). DIV software-based design tools are provided/described at omictools.com/deimmunization-tool and 2018.igem.org/Team:Tuebingen/Software.

Peptide vaccines, such as those that can be expressed from CEPESCs described herein, can be subjected to derivatization (e.g., PEGylation, PASylation, reductive methylation, or combinations) to block EP epitope(s).

Additional examples, approaches and compositions related to DIVs that can be adapted to such aspects or employed in such aspects are described in, e.g., Griswold K E, et al. Curr Opin Struct Biol. 2016; 39:79-88; Parker A S et al. J Bioinform Comput Biol. 2011; 9(2):207-229; De Groot A S, et al. Dev Biol (Basel). 2005; 122:171-194; Parker A S et al. BMC Bioinformatics. 2010; 11:180. Published 2010 Apr. 9; Choi Y et al. Methods Mol Biol. 2017; 1529:375-398; WO2017059270; EP3143137; U.S. Pat. No. 7,465,572; Roy A et al. Methods. 2017; 131:33-65; and Ferdosi S R et al. Nat Commun. 2019; 10(1):1842.

Undesirable BCEs can be removed by similar methods. Conformational BCEs can be removed by substitution of residues or non-inclusion of some parts of the conformational BCE. Examples of this approach are Schmohl J U et al. Toxins (Basel). 2015 Oct. 10; 7(10):4067-82 and Cantor J R et al. Methods Enzymol. 2012; 502( ):291-319. In other aspects, the number of BCEs are reduced by GSRVs, which are described in detail below.

2) Glycosylation Site Removal Variants (GSRVs and GSRAgVs)

In AOTI, an expression product comprises one or more AVs that comprise the removal of one or more possible or known glycosylation sites or glycosylation sites of a particular type. In one such aspect, an expression product, such as a gDAgFP can be characterized by one, some, most, generally all, or all of the N-linked glycosylation-associated sequences of the antigen being substituted to remove the potential/known N-linked glycosylation sites. For example, any or all of the N-X-S sequences, N-X-T sequences, or both, in such an antigen sequence can be modified by a substitution of the N residue. In AOTI, the N residues of any substituted sites are substituted with a D residue, an E residue, or either a D or E residue. In aspects, a linker alternatively or also is placed in one or more of such sequences as a substitute for the N residue. Such a linker can be a short linker, such as di-peptide (e.g., AA) or tripeptide linker or a mid-sized or longer linker (e.g., a GGGS, GSGS, or GGGG linker). In still another aspect, one or more of such sites are deleted. In aspects, amino acid sequences of the expression products outside of the Ag sequences also or alternatively are subjected to similar modifications such that at least one, at least some, most, generally all, or all of the sequences having such a pattern in such other amino acid sequences are also or alternatively substituted or removed. In AOTI, such modifications result in a detectably or significantly reduced humoral response to the expression product(s) comprising such modifications. In AOTI, such a reduced humoral response leads to a detectably or significantly longer/sustained immune response, clinically improved IR in a population, or combination.

3) Removal Variants/Decoy Epitope Removal Variants

In AOTI, an editope or AgV comprises a deletion of residue(s) from a WT epitope or Ag sequence. In AOTI, an editope comprises a sequence in which one or more decoy antigens are removed by substitution, deletion, or a combination thereof. Decoy epitopes are immunodominant epitopes with no known function. B cell decoy epitopes result in ineffective humoral immunity by inducing high level production of non-protective antibodies and silencing or diminishment of neutralizing Abs. In AOTI, an EP will comprise antibody sequences to the decoy epitope. In aspects, an EP will comprise a variant in which the decoy epitope is also or alternatively removed from the relevant sequence through substitution, deletion, or a combination thereof. Thus, in one AOTI the methods OTI are employed to treat a DCA that is associated with a decoy epitope effect. In AOTI, such a method is performed in swine.

Porcine circovirus (PCV) is an example of a virus that expresses a decoy antibody epitope on the surface of the viral particle. Relevant to other aspects of the invention, vaccines associated with decoy antigens also are typically 'leaky' because they are not effective in preventing infection ore reinfection, resulting in a buildup of viral reservoirs in immunized animals and higher rates of viral transmission and infection in a population. SFE Jin J et al. Biochem Biophys Res Commun. 2018; 496(3):846-851; Yu C et al. Vaccine. 2016; 34(50):6358-6366; and Trible B R et al. Virus Res. 2012; 164(1-2):68-77. Aspects of this invention specifically relate to the treatment or protection of swine against PCV and in one facet of such aspects the method comprises administering a sequence corresponding to a sequence normally comprising a PCV decoy Ag in which the decoy Ag has been removed. In AOTI, the decoy Ag is replaced in the sequence with a different PCV Ag, which may be associated with one or more linkers and connected to other upstream, downstream, or surrounding PCV Ag residues. Another virus comprising at least one decoy epitope is Porcine reproductive and respiratory syndrome virus (PRRSV) (SFE U.S. Pat. No. 9,441,015; Thaa et al. PLoS One. 2013; 8(6):e65548. Published 2013 Jun. 6; and Mateu E et al. Vet J. 2008; 177(3):345-351). The treatment or protection of swine against PRRSV represents another specific aspect of the invention. In AOTI, an EP comprises a PRRSV GP5 Ag sequence that comprises residues normally associated with the GP5 decoy epitope, but wherein the decoy epitope has been removed/replaced. Another example of a virus associated with a decoy epitope effect treatable by similar editope-comprising EPs is foot-and-mouth disease virus (SFE Szczepanek S M et al Clinical and Vaccine Immunology:CVI. 2012 April; 19:461-467).

d. Clinically Relevant Antigens (CRAs) and Putative CRAs (PCRAs)

In AOTI, EPs do not comprise any putative Ags, such as where the composition or method is employed for clinical application at a broad scale. In one such aspect, one, some, most, generally all, or all of the Ags of the EP are either known antigens, clinically relevant antigens (CRAs), or both. In AOTI, one, some, most, generally all, or all of the Ags of the EP or a portion of the EP such as the gDAgFP are CRAs.

A "clinically relevant antigen" (or "CRA") is an antigen that is known to be displayed on the surface of disease-associated cells, including or limited to immune system cells, in connection with a DCA in a species, patient type, population, or individual. In AOTI, a CRA is a CRA that has been identified in subjects of a particular species when experiencing a DCA. In AOTI, a CRA is an antigen that has been detected in a sample of a population impacted by the DCA. CRAs can be identified by taking one or more biological samples from such subjects, such as PBMC, and subjecting the samples to one or more methods that confirms, possibly isolates, possibly identifies, or possibly characterizes the DCA-associated antigens on cell surfaces. In AOTI, the method comprises expression library immunization, which is discussed elsewhere here. In one such aspect, the expression library immunization is performed with a gDAgFP-encoding construct comprising a putative CRA. In aspects, the method also or alternatively comprises peptide library screening, e.g., using flow cytometry. In still a further aspect, a method also or alternatively comprises performing one or more immunoproteomic methods, such as mass spectrometry methods (applied to Ags or Ag portions, such as proteolytically digested Ag fragments, removed from MHC:Ag complexes), to identify or characterize epitopes. The invention according provides expression products, such as gDAgFPs, comprising one or more CRAs. The invention also provides a method of preparing immunogenic compositions comprising the steps of (a) obtaining one or more samples from a subject exposed to a DCA, (b) identifying one or more putative CRAs from the one or more samples by applying one or more epitope identification methods, (c) developing one or more nucleotide sequences encoding one or more gDAgFPs comprising the CRAs, (d) assessing the immune response associated with the gDAgFPs, and (e) selecting one or more immunogenic compositions based on the results.

ix. Peptidic Checkpoint Modulators (PCMs) & Other CMs

In aspects, CEPs comprise peptidic checkpoint modulators (PCMs). CCCs and AACs can comprise PCMs, PCM-encoding NSs, & other checkpoint modulators (CMs). PCMs can modulate any such checkpoint pathway cell receptor (CPCR) or any such class of CPCRs. CCCs and AACs can be/comprise any PCM or corresponding PCMESNS that is described in this disclosure (and PCMs can comprise any PCM that corresponds to an immunomodulator (IM) CCC/AAC described herein).

A CM is any molecule that DOS modulates an immune checkpoint. Immune checkpoints typically are IM pathways (biological processes involving ≥2 interacting biomolecules usually of different types, but sometimes of the same type). Checkpoints ensure proper functioning of the immune system and prevent excessive host self-damage when IRs are triggered (e.g., by controlling the duration and extent of IRs).

Immune checkpoints are often overexpressed in tumor cells & cells within a tumor microenvironment (TME) and "hijacked" by several pathogens, compromising the ability of a host's immune system to mount an effective anti-DCA IR. E.g., PD-1, a CI, is a regulator of apoptosis and is critical for maintaining T cell expansion in IRs. Binding of PD-1 by its cognate ligand (PD-L1), attenuates the anti-tumor IR and promotes tumorigenesis. A PD-1/PD-L1 CI is a CI that blocks this interaction (checkpoint). A PD-L1 CI binds/blocks PD-L1 and a PD-1 CI binds/blocks PD-1. A PD-L1/PD-1 CI blocks either member of this checkpoint pathway.

Checkpoints can be either stimulatory, inhibitory, or situationally either stimulatory or inhibitory. Many IRs in TRs are regulated by a balance between several of such co-stimulatory and inhibitory signaling pathways.

Stimulatory checkpoints are often described as "co-stimulatory," as initial stimulation of the immune system is antigenic stimulation with the need for co-stimulation providing a "check" on the IR or the magnitude of an IR. Stimulatory pathways often are commandeered by DCAs, such as tumor cells promoting tumorigenesis. Co-stimulatory pathways proteins, such as OX40, GITR, ICOS, 4-1BB (CD137), have roles in proliferation and activation of cytokines production. Increasing the number of effector cells that express co-stimulatory molecules through cell therapy approaches can improve CEs. Inhibitory checkpoints reduce/block IRs even in the presence of Ag stimulation.

Typically, EP PCMs and many IM CCCs & AACs can be characterized as "immunoactivators" (or immunostimulators). An immunostimulator is an IM that promotes or amplifies IR(s). Activating IRs can, i.a., comprise proliferation of IC(s) (e.g., TCs), enhanced IC distribution/motility, or enhanced cytokine secretion. Immunoactivating EP PCMs include immunoactivating Abs, Ab FPs, & non-Ab PPTs (e.g., ICRs/ICRLs).

In aspects, immunoactivating PCMs or CCC/AAC IMs comprise checkpoint inhibitors (CIs), which act through suppressing inhibitory checkpoint pathways. Well-studied inhibitory immune checkpoint PPTs include PD1 and CTLA-4. Numerous additional CIs have also now been studied including lymphocyte activation gene-3 (LAG-3), B and T lymphocyte attenuator (BTLA), programmed death-1 homolog (PD-1H), T-cell immunoglobulin and immunoreceptor tyrosine-based inhibitory motif domain (TIM-3)/carcinoembryonic antigen cell adhesion molecule 1 (CEACAM1), VISTA, and the poliovirus receptor (PVR)-like receptors. SFE Torphy R J et al. Int J Mol Sci. 2017; 18(12):2642. Published 2017 Dec. 6, and Zahavi D J et al. Int J Mol Sci. 2019; 20(1):158. Published 2019 Jan. 4, discussing CIs that can be adapted/incorporated into CEPs, or used as CCCs or AACs.

CEPs can comprise any suitable number of PCMs of any suitable type. In aspects, CEPs comprise a single PCM. In aspects, CEPs comprise two PCMs. In aspects, CEPs comprise ≥2, ≥3, ≥4, or ≥5 PCMs. In aspects, OSMGAOA of any 2+ PCMs in a CEP are heterologous/not related. In aspects, OSMGAOA of any 2+ PCMS in a CEP are homologous/related (e.g., a CEP can comprise two gDPs that each act as CIs). In aspects, 2+ PCMs are expressed as separate PPTs. In aspects, a FP comprises 2+ PCM AARSs. In aspects, OSMGAOA PCM EPs are NFPs. In aspects, OSMGAOA PCM EPs of a CEP are FPs. In aspects, CEPs comprise a mix of PCM FPs and NFPs.

PCM(s) typically can be characterized as CPCRs, checkpoint pathway (CP) receptor ligands (RLs) (CPRLs), or as CPCR/CPRLs (many checkpoint pathways involve cell surface protein-to-cell surface protein interactions and some are self-ligand ICRs). In aspects, OSMGAOA PCM(s) are CPCRs or CPRLs; ICRs or ICRLs; or both. Some types of PCMs comprise forms that can be classified as CPCRs/CPRLs and other forms that are only CPRLs (e.g., VCAM-1 can either be a cell membrane bound PPT or a soluble ligand for its related receptor). This can be true of FFs and FVs, e.g., where only a soluble portion of a WT CPCR is used as a PCM. Typically, PCM(s) can also be characterized as being TS(s). E.g., PCM(s) that are ICRL(s) are also ICTS(s) with ICR RBDs. In aspects, OSMGAOA CEP PCM(s) or CCC/AAC IMs further can be classified as agonists, antagonists, partial agonists, partial antagonists or combinations thereof.

In aspects, any PCM referenced herein that has a heterologous ligand is co-expressed with its ligand in a CEP. In aspects, any PCM referenced herein that has a heterologous ligand is substituted with its ligand.

PCMs can have any suitable origin and composition. In aspects, OSMGAOA PCM(s) in a CEP comprise Abs or Ab FP. In aspects PCMs, such as PCM Ab PPTs can be multimeric, multivalent, multi-specific, or a combination of some or all thereof. Examples of immunostimulatory Ab(s) include anti-CD40L Abs, anti-OX40 Abs, anti-CD2 Abs, anti-CD28 Abs, anti-CD137 Abs, anti-CTLA4 Abs, anti-PD-1 Abs, anti-PD-L1/PD-L2 Ab, or anti-ICOS Abs. Ab FP PCM(s) can comprise AARS(s) from such Ab(s).

In aspects, OSMGAOA PCMs in a CEP are non-Ab PPTs. In aspects, OSMGAOA PCMs in CEPs are non-Ab EPs that are multimeric, multivalent, multi-specific, or exhibit a combination thereof. In aspects, PCM(s) are monospecific, but multivalent (e.g., PCMs can be trap protein(s), such as a trap protein specific for a checkpoint ICR).

In aspects, a PCM is a co-stimulatory molecule (CSM) ICR or CSM ICRL (e.g., B7, ICAM-1, LFA-3/CD58, 4-1BBL, CD59, CD40, CD70, VCAM-1, or OX-40L, or a ligand thereof). In aspects, a PIM also or alternatively can comprise a PPT or AARS of a T cell costimulatory molecule, such as CD28, CD40, or ICOS or a ligand or other immunomodulator thereof. In aspects, a PIM binds a co-stimulatory CD80 receptor, a CD86 receptor, or a CD46 receptor.

In aspects, a PCM is an inhibitor of IDO1, ID02, TD02, or A2aR. In aspects, the PIM is or is a ligand or adaptor for PD-L2 (B7-DC, CD273), TIM4, 2B4, B7-H2, B7-H3, B7-H4, B7-H6, CD2, CD27, CD28, CD30, CD30L, CD40, CD40L, CD48, CD58, CD70, CD80, CD86, CD96, CD112, CD113, CD137, CD137L, CD155, CD160, CD226, CD276, CRTAM, DR3, GAL9, GITR, GITRL, HAVCR2, HVEM, IDOI, ID02, ICOSL, ILT3, ILT4, LAIR1, LIGHT, LTBR, MARCO (macrophage receptor with collagenous structure), PS (phosphatidylserine), OX40L, SLAM, TD02, TL1A, VISTA, VTCN1, or any combinations thereof.

In aspects, OSMOA PCMs are immunoreceptor tyrosine-based inhibition motif (ITIM) receptor modulator(s). In aspects, a PCM blocks binding/activity of an ITIM receptor. Examples of ITIM receptors include NKG2A/CD94, PD-1, LIRs, SIRPa, TIGIT, and KIRs. In aspects, OSMOA PICCMs are non-ITIM CM receptor modulators. Examples of non-ITIM CM receptors include CTLA-4, LAG-3, TIM-3, and CD200R. In aspects, CEPs comprise both ITIM ICR and non-ITM ICR modulator(s). ITIM receptors typically are inhibitory, but in some cases are stimulatory.

In aspects, OSMOA PCMs are immunoreceptor tyrosine-based activation motif (ITAM) receptor modulators. In aspects, a PCM binds and activates an ITAM receptor. Examples of ITAM receptors include CD16, NKp30, NKp46, NKG2D, and DNAM-1. Typically, ITAM receptors are stimulatory. In some cases, ITAM receptors are inhibitory.

PCMs induce IRs in ≥1 types of cells. In aspects, OSMGAOA of cells are ICs. In aspects, PCMs primarily, generally only, or exclusively exhibit effects in ICs. In aspects, PCMs exhibit DOS effects in ICs and non-IC cells.

In aspects, OSMGAOA PCMs in CEPs exhibit significant IRs primarily, generally only, substantially only, or only in NKCs. Examples of PCMs that exhibit significant IRs in NKCs include modulators of activating NKC CPCRs e.g., CD94-NKG2C/E/H heterodimeric receptors; NKG2D; activating KIRs; natural cytotoxicity receptors such as NKp30, NKp44, and NKp46; & the nectin/nectin-like binding receptors DNAM-1/CD226 and CRTAM and NKC receptors (NKCRs) that inhibit NKC activation including inhibitory KIRs; CD94-NKG2A; & the nectin/nectin-like binding receptors TIGIT and CD96. Other NKCRs that regulate NKC activation include SLAM family receptors including 2B4/CD244, CRACC/SLAMF7, and NTB-A/SLAMF6, as well as Fc gamma RIIIA/CD16a, CD27, CD100/Semaphorin 4D, and CD160. The sialic acid-binding Siglecs (Siglec-3, -7, & -9), ILT2/LILRB1, KLRG1, LAIR-1, CD161/NKR-P1A, and CEACAM-1 are also NK cell inhibitory receptors. PVR is another NKC-associated CPCR (Xu F et al. Cancer Immunol Immunother. 2017; 66(10):1367-1375. Inhibitory T-cell receptors also present in NKCs include CTLA-4, PD-1, T cell immunoglobulin- and mucin-domain-containing molecule 3 (TIM-3), lymphocyte activation gene 3 (LAG-3), & TC immunoreceptor with Ig and ITIM domains (TIGIT). Beldi-Ferchiou A et al. Int J Mol Sci. 2017; 18(10):2129 and Sun H, Front Immunol. 2019; 10:2354 provide more.

In aspects, OSMGAOA IR(s) of PCM(s) PCGCOSCO or CO modulates both CTLs and NKCs. Examples of such ICRs include PD-1, LAG-3, TIGIT, and TIM-3 receptors. PCMs that modulate CPCR(s) common to NKCs and T-cells include TIGIT, NKG2A, & inhibitor KIRs or NKCs. In aspects, PCMs DOS modulate activity in T-cells and NKT cells. Examples of such PCMs include modulators of PD-1, LAG-3, and TIM-3.

In aspects, OSMGAOA IR(s) of PCMs(s) are in ≥2, ≥3, ≥4, or all of DCs, NKCs, INKT cell, γδ T cells, or B-1 B cells.

In aspects a PCM binds to a receptor expressed in epithelial cells, fibroblast cells, or both types of cells and induces IRs therein. Although not classified as ICs, such cells can be involved in IRs. E.g., epithelial cells can contribute to IRs and given their abundance can play a significant role in CEs. An example of such PCMs include HVEM-binding gDPs. Another checkpoint pathway involving many non-IC cells is the fibroblast activation protein-alpha (FAP) checkpoint pathway. SFE Chen L et al. Biochem Biophys Res Commun. 2017; 487(1):8-14. In aspects, PCMs comprise FAP PPTs or modulators of a FAP pathway. The use of FAP checkpoint modulators with gDAgFPs is exemplified in some of the Wistar Art and such approaches can be adapted to use in any of the the improved/novel CEPESCs described herein. In aspects, PCMs do not comprise FAP PPTs or FAP modulators. In aspects, PCMs primarily, generally only, substantially only, or only exhibit significant IR(s) in ICs.

Examples of modulators that exhibit primarily ITIC IRs, particularly primarily NKC and DC IRs, include SLAM receptor modulators (e.g., SLAM CPRLs such as CRACC modulators, e.g., CRACC inhibitors, and SLAM STAPs, such as EAT-2 PPTs), modulators of KIRs, modulators of NKG2Ds, and modulators of STING PPTs.

In aspects, OSMGAOA of the PCMs in CEPs exhibit IRs, are expressed endogenously, or both, primarily, generally only, substantially only, or only in (1) DCs, (2) in DCs and T-cells, (3) in DCs and NKCs, or (4) in DCs, NKCs, and T-cells. Examples of such PCMs include modulators of PD-1/PD-L1 PPTs, ILT2 modulators, and TIM-3 modulators. In aspects, OSMGAOA PCMs are PPTs corresponding to DC PPTs expressed only (or significantly more expressed)

upon DC stimulation (e.g., DC-TLR stimulation), such as PD-L1 PPTs or ILT2 PPTs, or modulators thereof.

In aspects, a PCM is a PPT that has an expression induced by APC (e.g., DC) activation/maturation or is an FF or FV thereof. In aspects, a PCM is a CPCR or CPRL primarily expressed on APCs, such as DCs, e.g., GITRL.

In aspects, a PCM is a soluble isoform of a WT PPT having other isoforms that are expressed as CPCRs. An example of such a PCM is a soluble canine CD80 isoform, a soluble human CD80 isoform, or a canine CD86 soluble isoform (or FFs or FVs thereof).

In aspects, CEPs include ≥2 PCMs that are heterologous. In aspects, PCMs include ≥2 PCMs that modulate pathways of different CPCR families (discussed below). Examples of such aspects include combination of PD-1 pathway blocking PCMs with CD20-blocking PCMs, inhibitory KIR-blocking PCMs, TIGIT blocking PCMs, and the like. Additional examples of such combinations are mentioned below.

In aspects, PCMs DOS result in reduced T-cell anergy, reduced IC tolerance, enhanced IRs (including proliferation of ICs, activity of ICs, or both), enhanced CEs, and combinations of any thereof.

In aspects, a PCM exhibits DOS IRs in DCs. In aspects, OSMGAOA PCMs of a CEP primarily, generally, substantially only, or only exhibit significant IRs in DCs. In aspects, OSMGAOA PCMs primarily, generally, substantially only, or only exhibit significant IRs in DCs and other ITICs (in aspects only DCs and NKCs). In aspects, PCM(s) of CEPs exhibit DOS IRs in ≥2 of DCs, T-cells, and NKCs (e.g., all 3 cell types). In aspects, PCM(s) of CEPs exhibit DOS greater IRs in DCs than in other cells. In aspects, PCM(s) exhibit DOS more IRs in ITICs than other cells or only exhibit DOS IRs in ITICs (such PCMs can be referred to as "ITIIMs" (innate trained immunity immunomodulators) herein). In aspects, PCM(s) exhibit DOS IRs in ICs, comprising DCs than other cells. Examples of PCMs that exhibit significant IRs in DCs include modulators of DEC-205, Langerin, Clec9A, DC-SIGN216, and MR217, and other DC ICRs described herein. In aspects, modulators of any such ICR(s) can be PCMs.

PCMs and other CIs have been extensively studied. Examples of PCMs and other CIs and related principles and methods applicable to these aspects are described in, e.g., De Sousa Linhares A et al. 2018; 9:1909; Khan M et al. Front Immunol. 2020; 11:167; and Sun H et al. Front Immunol. 2019; 10: 2354.

a. ITMs and ITICITMs

In aspects, OSMGAOA EPs in a CEP are internal target immunomodulators (ITMs/ITIMs) (e.g., PCMs and other EPs that modulate a checkpoint pathway through modulating an internal portion of a PPT or a PPT or other target present in the interior of a cell). CEPs can comprise any suitable number and any suitable type of ITIs. Most ITMs modulate a checkpoint pathway, e.g., by directly interacting with a CPCR or another factor downstream of a checkpoint pathway signaling cascade or upstream of a checkpoint cascade (e.g., a transcription factor). As such, ITMs are discussed here. However, ITIs can include PPTs that are not associated directly or otherwise with checkpoint modulation. CEPs can include any suitable number of any suitable type of ITIs. A number of ITMs are known in the art and can be incorporated in CEPs. Accordingly, such PPTs are described briefly here.

In AOTI, ITIs in CEPs include modulators of phosphoinositide-3 kinase (PI3K)/Akt/mTor ("PAM") pathway/cascade system, which although not classified as a CM in the art, is related to CM functions/pathways and includes CM elements, such as PTEN, and accordingly is included here, although this exemplifies that ITIMs include both PCM and non-PCM PPTs (despite being described under the heading of "Checkpoint Modulators"). In aspects, ITIMs include PAM pathway inhibitors. Examples of such PAM pathway inhibitors include YVPGP (SEQ ID NO:731), P6-55 (Guo W et al. Cancer Lett. 2017; 405:1-9), and the peptides described in WO2016103176. In aspects, such an inhibitor is a PTEN PPT (SFE Dillon L M, Miller T W. Therapeutic targeting of cancers with loss of PTEN function. Curr Drug Targets. 2014; 15(1):65-79). Additional examples of ITIs are agents that block IκBα, NF-κB PPTs, HLA-B-associated transcript 3 (BAT3) PPTs, NOX2 inhibitors, and nuclear proteins such as mixed-lineage leukemia protein-5 (MLL5) PPTs (e.g., splice variants thereof that induce IR(s)) or PPTs that block proliferating cell nuclear antigen (PCNA), such as anti-PCNA intrabodies.

In aspects, CEPs comprise ITI(s) that modulate a transcription factor involved in IRs/CEs against CDAs, a protein that modulates a transcription factor, an internal portion or internally present oncoprotein, or a combination thereof. Examples of such it is include modulators of the human murine double minute 2 (MDM2) oncoprotein/p53 pathway or a MDMX/p53 pathway (exemplified by, e.g., Midgley C A et al. Oncogene. 2000; 19(19):2312-2323 and Phan J et al. J Biol Chem. 2010; 285(3):2174-2183). Additional transcription factors ("TFs") involved in IRs include E2A, Pax5, EBF, PU.1, Ikaros, GATA3, Th-POK, Tbet, Bcl6, NF-κB, STATs, and IRFs. EPs can include modulators of such TFs that induce IRs. E74-like ETS transcription factors (e.g., ELF-1 and ELF-4) (SFE Seifert et al. PLoS Pathog. 2019; 15(11):e1007634). EPs can, e.g., comprise ELF PPTs, FFs, or FVs. In aspects, EPs include one or more ITI PPTs of the interferon-regulatory factor (IRF) proteins (IRF) family of TFs or FFs or FVs thereof (described in, e.g., Yanai H et al. Oncoimmunology. 2012; 1(8):1376-1386). Additional TFs involved in IRs include PPTs of the nuclear factor of activated T-cells (NFAT) family, Activator Protein-1 (AP-1) (inhibitors of AP-1 are EPs in one aspect), and NF-κB. In aspects, an ITI is a PPT involved in ubiquitinylating PPTs, such as a ubiquitin ligase (DEH). An example of such an ITI is tripartite motif containing-21 (TRIM21) (in aspects a TRIM21 CEP comprises anti-viral Ag(s)).

In other aspects, ITI(s) comprise MAPK pathway PPTs or modulators thereof, e.g., p38 MAPK PPT(s). In aspects, ITI(s) comprise ERK1/2 pathway PPT(s) or modulator(s) thereof (e.g., inhibitors of such a pathway CB enhanced Th1 IR(s)/reduced Th2 responses).

ITIs can have any suitable origin/homology. In aspects, OSMGAOA ITIs in CEPs are non-Ab PPTs. In aspects, OSMGAOA ITIs are Abs or Ab FPs. In aspects, OSMGAOA Ab CEPs are intrabodies (Abs targeting intracellular targets including in the cell of expression (COE)). In aspects, an intrabody FP comprises ERTPS(s). In OSMGAOA ITIMs are Ab FPs or Non-Ab FPs that comprise a cell penetrating peptide (CPP). CPPs and intrabodies that can be adapted to such aspects are discussed elsewhere here and in Singh K et al. Chem. 2019; 30(4):1028-1041. PPTs comprising CPPs or certain antibody domains have been shown to be cell infiltration (e.g., anti-DNA and anti-RNA Abs, SFE Park H et al. Front Immunol. 2018; 9:2019) and can be incorporated as TSs or facilitators of cell uptake. Many FPs of the invention also are taken up by other cells by TSs (e.g., gDP FPs) and can deliver EPs to intracellular targets.

In aspects, OSMGAOA PCMs are innate trained immunity cell (ITIC) internal target modulator(s) (ITICITMs). ITICITMs modulate activity of targets primarily, generally only, substantially only, or only expressed in ITICs; modulate IRs primarily, generally only, substantially only, or only in ITICS; or both. Thus, ITICITMs typically do not include ITSs, such as PTPSs, ERTPSs, TFs, and the like, which exhibit expression in many cells besides immune cells and are involved in biological processes not related to IRs.

ITICITMs typically DOS bind PPTs or portions of PPTS present in the internal portions of ITICs, rather than extracellular targets (e.g., internal portions of CPCRs, cytosolic PPTs, or organelle associated PPTs). ITICITMs typically also are PCMs. Effective inclusion of ITICITM ESs (resulting in DOS IRs) in constructs is a surprising aspect of the invention. In aspects, ITICITMs in CEPs DOS induce IRs in cells in which they are expressed, in other cells, or both. Examples of ITICITMs include, e.g., STING modulators and ITIC signal transducing adaptor proteins (ITICSTAPs), e.g., EAT-2 PPTs (discussed below).

In aspects, PCM(s) comprise STING (simulator of interferon genes) modulator(s) (e.g., STING agonists), STING PPTs, or both. STING modulators, related techniques, and applicable principles are described in, e.g., US20180085432 and WO202002874. In aspects, a STING modulator(s) DOS exhibit IRs in T-cells, NKCs, monocytes, or combinations. In aspects, STING modulator(s) DOS primarily exhibits IRs in such cells. In aspects, STING modulator(s) also exhibit DOS IR(s) in lung, ovary, heart, smooth muscle, retina, bone marrow, or vagina cells. In aspects, a STING modulator EP comprises a mitochondrial ITS, such as those known in the art (SFE Diekert K et al. Proc Natl Acad Sci USA. 1999; 96(21):11752-11757; Del et al. Mol Ther. 2003; 7(6):724-730; and Yogev O et al. Biochim Biophys Acta. 2011; 1808(3):1012-1020), a lysosome TS such as those of lamp-1, LIMPII, or MHCII invariant chain (SFE Starodubova E S, et al. Acta Naturae. 2014; 6(1):61-68; Behnke J et al. FEBS Lett. 2011; 585(19):2951-2957; and Schrader-Fischer G, et al. 1997; 68(4):1571-1580) an ERTPS, or CT. In aspects, a STING modulator EP is a cGAS PPT (e.g., Uniprot Q8N884, I3LM39, or E1BGN7, a homolog, a chimera, a FF, or FV of any such PPT); a TMEM203 PPT (or FF or FV) (see Yang et al. PNAS August 2019, 116 (33) 16479-16488). In aspects, CEPs comprise PPTs that block proteins that block STING activity (e.g., an anti-DENV or anti-Zika virus NS2B3 PPT Ab).

In aspects, ITMs are factors in or modulators of factors in a checkpoint cascade, such as signaling mediators. E.g., CEPs can comprise PLCγ1, PLCγ2, and PI3K PPTs, which are signaling mediators of EAT-2/CRACC checkpoint pathway(s), e.g., in NKCs.

b. Functional Classes of PCMs/CMs

In aspects, CMs/PCMs can be characterized on their function or primary function, such as co-stimulation/activation, inhibition, or both. In aspects, CMs/PCMs are characterized on primarily, but not exclusively, exhibiting such properties, situationally exhibiting such properties, or both. E.g., CD27 modulators activate T-cell activity, but also have been shown to inhibit Th17 IRs. In aspects, CEPs comprise both CIs and CSMs. In aspects, CCs comprise only CI or CSM CCCs. In aspects, CI or CSM IM AACs are AAW CEPESCs. In aspects, such CEPESCs comprise PCMES(s).

1) Checkpoint Activators (Co-Stimulatory Molecules)

In aspects, OSMGAOA PCMs in CEPs are CSMs. In aspects, OSMGAOA PCSMs are ICRLs of co-stimulatory ICRs. Examples of peptidic CSMs that can be in CEPs include 4-1BBL PPTs (e.g., a WT PPT, a FF, or a FV of either), GITRL PPTs, CD80 (B7.1) PPTs, CD28L PPTs, CD137L PPTs, ICOS ligand PPTs, CD86 (B7.2) PPTs, CD70 PPTs, H7-H7 PPTs, CD30 PPTs, CD40 PPTs, and HVEM PPTs. In aspects, CEPs comprise FFs or FVs of such PCSM(s).

Examples of PCSMs include activating modulators of GITR (CD357) (e.g., a GITRL PPT), CD28 (e.g., PD-L1 PPTs or B7-1 PPTs), or ICOS. In aspects, a PCM modulates a T-cell CSM CPCR. Examples of such PCMs include modulators of OX40 (CD134) (e.g., OX40L/CD252 PPTs), 4-1BB (CD137 (e.g., CD137L PPTs)), CD28, CD27, ICOS, and CD122. In aspects, a PCM modulates a B cell CSM CPCR (e.g., a CD40 modulator, a completement receptor modulator, a CR2 modulator (e.g., a CD19 or CD81 PPT), or CT.

2) Checkpoint Inhibitors and PCIs

In aspects, OSMGAOA PCMs in CEPs are peptidic CIs (PCIs). In aspects, PCM(s) exhibit DOS checkpoint inhibition effects in T-cells, NKCs, DCs, or combinations. In aspects, PCM(s) primarily, generally, or at least substantially only exhibit DOS checkpoint inhibition IRs in T-cells and NKCs. Examples of checkpoint inhibitors include CTLA-4 (CD152), PD-1/PD-L1 (CD274) or PD-L2 (CD273) checkpoint inhibitors. Other examples of checkpoint inhibitors include PCMs that inhibit a LAG-3 (CD223) or KIR (CD158) checkpoint, or that inhibit a TIM-3, TIGIT, Galectin, Poliovirus receptor (CD155), or 4-1BB (CD137) checkpoint pathway, or combinations of any of these or other CIs described in this disclosure or known in the art. CIs and CI ligands that can be adapted for inclusion in CEPs are described in, e.g., Chen L, Flies D B. Molecular mechanisms of T cell co-stimulation and co-inhibition [published correction appears in Nat Rev Immunol. 2013 July; 13(7):542]. Nat Rev Immunol. 2013; 13(4):227-242.

In aspects, as discussed further herein, gDPs of CEPs can act as checkpoint inhibitors, DOS inhibiting the HVEM/BTLA checkpoint pathway. In aspects, CEPs comprise both gDP CI(s) and NGDCI(s). In aspects, CEPs only comprise gDP CI(s). In aspects, the only type of PCMs in CEPs are gDPs. In aspects, CEPs comprise gDP CI(s) and PCSM(s) (e.g., 4-1BB pathway CSMs or GITR pathway CSMs). In aspects, gDPs of a CEP do not act as CIs in TRs (e.g., gDPs do not block HVEM in non-HVEM-expressing TRs, such as pigs). In aspects, the only EPs with CI function are NGDCIs. Examples of NGDCIs are discussed above and throughout this disclosure and include, e.g., LAG-3 CIs, TIM-3 CIs, and KIR CIs.

b. Signal Transducing Adaptor Protein PCMs (ICSTAPs & CPSTAPs)

In aspects, OSMGAOA PCMs in CEPs are signal transducing adaptor protein(s) (STAPs) that DOS modulate IC activities (ICSTAPs) or a modulators of such proteins (e.g., in the case of inhibitor STAP(s)). In aspects, OSMGAOA of the PCMs of a CEP are STAP(s), STAP modulators, or both, that modulate checkpoint pathway(s) (i.e., CPSTAPs or CPSTAPMs). In aspects, PCMs can be classified as both (1) immune cell STAPs (ICSTAP(s)) due to primary expression in ICs and (2) CPSTAP(s). In aspects, a PCM is a modulator of an ICSTAP, CPSTAP, or both. In aspects, an ICSTAP EP induces IRs. In aspects, a CPSTAP activates IRs in ICs. In aspects, an ICSTAPM/CPSTAPM blocks/inhibits an inhibitory STAP in a CI or CI-like manner, resulting in induced IRs.

STAPs (a.k.a. "adaptor proteins" sometimes presented as "adapter" proteins) are PPTs that modulate signal transduction pathways, such as ITIM-mediated pathways (discussed above), ITAM pathways, or other pathways. STAPs are characterized in typically lacking intrinsic catalytic activity, functioning instead by inducing PPT-PPT interactions (e.g., between effectors and enzymes) to form PPT complexes, modifying (e.g., nucleating) such complexes, or both, and thereby causing signal transduction event(s). Adaptor proteins typically are multi-domain PPTs & contain protein-binding motif(s), which facilitate interactions between protein-binding partners & the generation of such enhanced signaling complexes. Adaptor proteins can govern signaling cross-talks in time and space. STAPs typically exhibit subcellular localization.

In aspects, ICSTAP(s) in CEPs DOS coordinate signal transduction cascades controlling effector function(s) in ICs including motility, activation, proliferation, and differentiation in IC type(s). In aspects, STAP EPs DOS modulate one or more immune checkpoints and, accordingly, are CPSTAP(s).

Examples of WT STAPs include adaptor protein complex 3 (AP-3), which is required for the efficient presentation of glycolipid antigens that require internalization and processing. STAP DAP10 stimulates survival and cytotoxicity of NK cells and provides co-stimulation to activated T cells. STAP DAP12 possesses an immunoreceptor tyrosine-based activation motif (ITAM) which, after phosphorylation, recruits Src family kinases ZAP70 and Syk, responsible for cytokine release and enhancement of cytotoxicity in NK cells. Another type of an adaptor is a slp-76 family adaptor. STAP Slp-76 is expressed in T cells, monocytes/macrophages, NK cells, mast cells and platelets. BLNK reflects the slp-76 homolog in B cells (sharing similar domain structure and 33% identity) and is primarily responsible for the transmission of signals through the B cell receptor (BCR). Other known IM adaptor proteins include Nck and Itk (which impacts survival, development and cytokine production of NKT cells). In NK cells, the DAP-12 adaptor (that acts on KIRs in heterodimeric complexes and TREM-1), the AP2 clathrin adaptor (which mediates KIR endocytosis), the Crk adaptor (which in unphosphorylated form can overcome KIR inhibition), and the EAT-2 activator (that acts on SLAM family receptors to activate NK cell activity). Among the three ITAM-bearing adaptor molecules, FcRγ and CD3ζ chains associate with CD16, NKp30 and NKp46 receptor by forming either homodimers or heterodimers, whereas DAP12 associates with the NKp44 receptor. Innate immune receptor-associated adaptors include MyD88 or TRIF, which are known to induce IR(s). TNFa CPCRs are modulated by TRAF adaptors, which can be incorporated in CEPs. Numerous other examples of adaptor proteins are known in the art. EPs can comprise any suitable type of adaptor protein PPT or AARS or combination of adaptor protein PPTs or AARSs, including 1+ of the adaptors mentioned here.

In aspects, OSMGAOA of STAP CEPs are transmembrane adaptor proteins (TRAPs), such as WT TRAPs, FFs of TRAPs (soluble or nonsoluble), or FVs thereof. Examples of TRAPs include LAT, NTAL (non-T-cell activation linker), PAG (protein associated with glycosphingolipid-enriched microdomains) and LIME (LCK-interacting membrane protein), TRIM (TCR-interacting molecule), SIT (SH2-domain-containing protein tyrosine phosphatase (SHP2)-interacting transmembrane adaptor protein) and LAX (linker for activation of X cells, where X denotes an as yet unidentified cell). In aspects, a PCM comprises an inhibitor of an inhibitory TRAP. In aspects, a PCM comprises a stimulatory TRAP PPT or a modulator of a stimulatory TRAP PPT that DOS induces IRs. In aspects, a TRAP PPT is of or is related to a lipid raft-associated TRAP PPT or a TRAP modulator acts on such a TRAP PPT. In aspects, a TRAP PPT is a non-lipid raft associated TRAP or a modulator of such a TRAP. TRAPs are reviewed in, e.g., Hořejší, V et al. *Nat Rev Immunol* 4, 603-616 (2004). https://doi.org/10.1038/nri1414.

In aspects, CPSTAP(s)/ICSTAP(s) are expressed in ITICs. Examples of such STAPs include the adhesion and degranulation-promoting adapter protein (ADAP) expressed in NKCs and DOS modulating IRs (such as priming, cytokine production, & cytotoxicity). B cell activating STAPs include NCK which is involved in Ab functions & processing of large Ags. In aspects, ICSTAPs/CPSTAPs modulate T-cell activity. Examples of such STAPs include CG-NAP/kinase, which modulates T cell activation, proliferation, differentiation, & migration; the Grb2-related adaptor downstream of Shc (Gads) that modulates T cell-mediated immunity; and adaptor protein Shc, which interacts with Gads. Additional adaptors that modulate T cell pathways/functions include the zeta (ζ)-chain associated protein of 70 kDal (Zap-70) and the linker for activation of T cells (LAT). CEPs can comprise any such STAP, or FF or FV.

In aspects, a STAP EP modulates IRs in multiple IC types, interacts with multiple PPTs involved in IRs, or both. The adaptor SLP-76, for example, modulates both NK cell activating receptor functions and NKT cell functions, such as selection, differentiation, and activation. Several proteins involved in IRs, signal pathways, or both, are modulated by 1, 2, or more STAPs. E.g., PI3K, which modulate signaling pathways downstream of immunoreceptor engagement are engaged by STAP B-cell adaptor for PI3K (BCAP) in B cell modulation and the adaptors SLP-76 and LAT in T cell modulation, and SLP-76 also modulates Vav family proteins in NK activating signal transduction. Similarly, SH2 domain-containing inositol 5'-phosphatase (SHIP) which both regulates the PI3K pathway and CD4 signal pathways is modulated by adaptors Dok-1/2 (Waterman P M et al. Immunol Lett. 2012; 143(1):122-130). Like SLP-76 adaptors, Crk STAPs (Crk, CrkII, Crk I, v-Crk, or CrkL—SFE Birge, R. B et al. Cell Commun Signal 7, 13 (2009) modulate numerous PPTs (e.g., p130cas, p120-C-Cbl, Cbl-b, NKG2D, Abl, Gab3, ZAP70, HPK1, SDF-1, C3G, BCR, KIRs, and PI3K to modulate IRs in T, B, and NK cells, including T-cell activation and NK cell activation. CEPs can comprise any of these or functionally similar STAPs, FFs, or FVs. ICSTAPs FcR-γ & DAP12 modulate activity of a number of ICRs, in some cases inhibiting activity (e.g., in NKp44) and in other activating activity (e.g., Dectin-2 & TREM-2) (SFE Hamerman J A et al. *Immunol Rev.* 2009; 232(1):42-58)

In aspects, CEPs comprise 2+ ICSTAPs, CPSTAPs, or both, which interact in TR immune systems (e.g., Crk and dok1). In aspects, an adaptor primarily, generally only, substantially only, or only exhibits effects in ITICs, AICs, or both cell types. In AOTI, CEPs comprise TRAF adaptor STAP(s). In AOTI, STAP(s) comprise PPT(s) that block c-Cbl, Cbl-b, or both.

In aspects, CEPs comprise STAPs that modulate ICRs of the signaling lymphocyte activation molecule (SLAM) family. In aspects, OSMGAOA of PCPMs in CEPs are adaptor(s) of a SLAM receptor. In aspects, OSMGAOA SLAM receptor adaptors (SLAMRAs) contain SH-2 motif (s), contain cytoplasmic ITIMs, are tyrosine phosphorylated PPTs, or exhibit a combination thereof. In aspects, PCMs are STAP(s) that modulate a SLAM receptor that is regularly expressed in DCs (e.g., SLAM1, SLAM2, SLAMF5, or SLAMF7).

In aspects, CEP PCMs are STAP(s) that DOS modulate SLAMF5/CD86, SLAMF7/CRACC, or both. In aspects, such STAPs primarily induce IRs. WT SLAM-modulating STAPs include SAP (SLAM-associated protein—also named SH2D1A), Ewing's sarcoma-associated transcript-2 (EAT-2; also named SH2D1B1) & EAT-2-related transducer (ERT; also named SH2D1B2) ("SAP family adaptors" or SAPFAs). In AOTI, PCMs comprise WT SAPFAs or SAPFA FPs comprising WT SAPFA AARSs. In AOTI, PCMs comprise FFs of SAPFAs in NFPs or FPs. In AOTI, PCMs comprise FVs of SAPFAs in NFPs or FPs. In aspects, OSMGAOA SAPFAs in CEPs are in FPs. In AOTI, OSMGAOA SAPFAs in CEPs are contained in gDPFPs (gdFPs). In aspects, OSMGAOA SAPFAs in CEPs are EAT-2 PPTs (e.g., EL WT EAT-2s, FFs thereof, or FVs). In aspects, EAT-2 PPTs are hEAT-2 PPTs (EL WT hEAT-2, FFs thereof, or FVs thereof).

c. CPCR Family Characteristics

In aspects, PCMs can be characterized on the basis of the structural characteristics of the CPCRs involved in the checkpoint pathway. In aspects, PCMs are ligands of such CPCRs. In aspects, PCMs are CPCRs (e.g., CPCRs that bind other CPCRs, CPCRs that are self-ligands, such as self-ligand SLAM CPCRs, or soluble forms of CPCRs, either WT soluble forms or soluble FFs/FVs of non-soluble CPCRs). In aspects, PCMs modulate B7/CD28 family/superfamily CPCR pathway(s). In aspects, PCMs modulate immunoglobulin CPCR pathway(s). In aspects, PCMs modulate TNF superfamily CPCR pathways. In aspects, CEPs comprise PCMs that modulate checkpoint pathways involving CPCRs of two of these families/superfamilies ("families"). In aspects, CEPs comprise PCMs that modulate checkpoint pathways involving CPCRs of all three families. In aspects, CEPs comprise two or more PCMs that modulate two or more CPCRs in at least one of these families (e.g., two or more PCMs that modulate TNF superfamily CPCRs or 2+ PCMs that modulate B7 family CPCR pathways and 2+ PCMs that modulate immunoglobulin superfamily CPCR pathways). The characteristics of such CPCR families and modulators are briefly discussed below. The art sometimes characterizes the B7 and immunoglobulin families as a single family as these families share similar structural characteristics. AOTI can accommodate either treatment of such receptors, but this disclosure adopts the treatment of these two classifications as separate families.

1) B7/CD28 Family

In aspects, PCMs include modulators of a B7 CPCR pathway. The CD28/B7 family CPCR pathway includes CD28 and CTLA-4 and their ligands B7.1 (CD80) and B7.2 (CD86); ICOS and ICOS ligand (ICOSL); and the coinhibitory receptor Programmed Death Receptor 1 (PD-1) and its ligands PD-L1 and PD-L2; the CD28 homolog member B and T lymphocyte attenuator (BTLA); and 2 B7 homologs B7-H3 and B7-H4 (B7x, B7S1).

Some in the art divide the B7/CD28 superfamily between B7 family CPCRs/ligands, e.g., B7-1 (CD80), B7-2 (CD86), B7-H2 (ICOSL), programmed death ligand 1 (PD-L1), programmed death ligand 2 (PD-L2), B7-H3, B7-H4, B7-H5, B7-H6, and B7-H7 and CD28 family CPCRs/CPRLs, e.g., CD28, CTLA-4, ICOS, PD-1, and B- and T-Lymphocyte Attenuator (BTLA). Additional members of this PPT family include ILDR2 (Hecht I et al. 2018; 200 (6):2025-2037).

In aspects, OSMGAOA B7/CD28 family CPCR pathway PCMs are PPTs of or related to or are modulators of B7 family CPCR pathways or PPTs. In aspects, OSMGAOA B7CD28 family CPCR pathway PCMs in CEPs are PPTS of or related to or are modulators of CD28 family CPCR pathways or PPTs In aspects, B7 CPCR pathway modulating PCM(s) modulates a costimulating pathway (e.g., the CD86/CD28 pathway), an inhibitory pathway (e.g., CD80/CTLA4), or both. In aspects, PCMs block activity of inhibitory B7 CPCR pathways (e.g., B7-H3). Other PPTs in the B7 family CPCR that can be or can be modulated by PCMs include, e.g., B7-H6, B7-H7/HHLA2, PDCD6, TMIGD2/CD28H, VISTA/B7-H5/PD-1H, Nkp30, TMIGD2, HHLA2, CD276, B7-DC, B7-H5, and CD272. Homologs of such factors occur in several species (SFE Chen W et al. PLoS One. 2011; 6(6):e21341. doi:10.1371/journal.pone.0021341, with respect to porcine B7-H3, which in one aspect is blocked/inhibited by a PCM that modulates this pathway). In aspects, B7/CD28-related PCM(s) in CEPs DOS induce T cell activation, T cell proliferation, IC cytokine production, promotion of TC survival, B cell activation, TH cell differentiation, IC cytotoxicity (e.g., NKC-mediated cytotoxicity, CTL-mediated cytotoxicity, or both), or combinations of any/all thereof.

PD-1 Pathway Modulating PCMs

In aspects, PCMs comprise a member or modulator of a PD-1 checkpoint pathway. In aspects, PCMs comprise a PD-L1-binding PPT, a PD-L2 binding PPT, or both. In aspects, PCMs comprise inhibitors of a PD-1 pathway. In aspects, PCMs comprise PD-L1 Abs or Ab FPs. In aspects, PCMs comprise non-Ab PD-L1 binding PPTs. In aspects, PCMs comprise multimeric non-Ab PD-L1 trap proteins. In aspects, a PCM comprises a FF of a PD-1, such as a PD-L1 extracellular binding domain (or a FV thereof). In aspects, PCMs comprise a PD-1 PPT or other PD-1 modulator, such as a PD-1 extracellular binding domain (or a FV thereof). PD-1/PD-L1 PPTs and modulators thereof are known. E.g., PPTs comprising extracellular domains of PD-1/PD-L1 are described in, e.g., Zhu Y P et al. Can. J. Vet. Res. 81 (2), 147-154 (2017) and anti-PD-L1 Abs are described in, e.g., WO2013079174; CN101104640; WO2010036959; WO2013056716; WO2007005874; WO2010089411; WO2010077634; WO2006133396; WO201309906; US 20140294898; WO2013181634 and WO2012145493. In aspects, PCMs are endogenously expressed in TRs or a RVRHR or SI to CIs endogenously expressed in TRs. E.g., in aspects TRs are pigs and CEPs comprise a PD-1 or PD-L1 PPT or modulator that is expressed in pigs, such as an extracellular domain of a PD-1 or PD-L1 PPT.

CTLA-4 Pathway Modulating PCMs

In aspects, a PCM is a member or modulator of a CTLA-4 checkpoint pathway. In aspects, PCM(s) block CTLA-4 to CD80 (B7-1) and/or CD86 (B7-2). In AOTI, the CTLA-4 AARS or PPT comprises at least a portion of an anti-CTLA-4 Ab, such as ipilimumab or ticilimumab. Such Abs are described in, e.g., WO2001014424; WO2012120125; WO2009100140; WO2007123737; WO20100979597; WO200612168; U.S. Pat. Nos. 6,682,736; 6,207,156; 6,984, 720; 7,109,003; and 7,132,281; or comprises AARSs of a CTLA-4 ligand (SFE WO1996040915). In aspects, inclusion of a PCM that blocks a CTLA-4 pathway DOS enhances IRs, such as T-cell or NKC IRs, e.g., T-cell activation, enhanced NKC cytotoxicity, or both, and in anti-cancer applications can DOS exhibit enhanced tumor/TME-infiltration of T cells (e.g., CD8 cells), NKCs, or both.

VISTA Pathway Modulating PCMs

In aspects, CEPs comprise PCM(s) that modulate a V-domain Ig suppressor of T cell activation (VISTA) pathway (sometimes VISTA is also referred to as B7-H5, although HHLA2 also has been described as B7-H5). In aspects, such PCM(s) DOS induce T-cell IR(s). In aspects, PCM(s) block VISTA pathway(s). In aspects, such PCM(s) comprise anti-VISTA Abs or Ab FPs. Anti-VISTA Abs are known in the art (e.g., NCT02671955) (see also Deng J et al. J Immunother Cancer. 2016; 4:86).

(a) Butyrophilin CPCR Family Modulators

In aspects, PCMs modulate a checkpoint pathway associated with a Butyrophilin family CPCR. These CPCRs are sometimes classified as B7 family CPCRs. Examples of such CPCRs include BTN1A1/Butyrophilin, BTN2A1, BTN2A2/Butyrophilin 2A2, BTN3A1/2, BTN3A2, BTN3A3, BTNL2/Butyrophilin-like 2, BTNL3, BTNL4, BTNL6, BTNL8, BTNL9, BTNL10, and CD277/BTN3A1. In aspects, PCMs block the action of inhibitory Butyrophilin pathway(s) (e.g., a BTN1A1, BTN2A2, or BTNL2). In aspects, PCMs activate stimulating Butyrophilin pathway(s). In aspects, PCMs comprise a BTN3A PPT, which in aspects DOS promotes DC survival. The biology of such PCMs is discussed in, e.g., Malinowska M et al. Cent Eur J Immunol. 2017; 42(4):399-403. doi:10.5114/ceji.2017.72806. In aspects, Butyrophilin pathway PCMs DOS modulate CD4 T-cell activity.

(b) ILTICD85 (LIR/ILIR) CPCR Family Modulators

In aspects, PCMs comprise ILT/CD85-ILIR (Inhibitory leukocyte immunoglobulin-like receptor A/B) CPCR modulator(s) (also described as or overlapping with Leukocyte immunoglobin-like receptor (LIR) CPCR pathway). In aspects, such PCMs DOS induce T-cell IRs. Examples of such CPCRs and associated ligands include LILRA1/CD85i, LILRA2 (ILT1)/CD85h, LILRA3 (ILT6)/CD85e, LILRA5/CD85f, LILRA6/CD85b, LILRA4/CD85g/ILT7, LILRB1/CD85j/ILT2, LILRB2/CD85d/ILT4, LILRB3/CD85a/ILT5, and LILRB4/CD85k/ILT3. Modulators of such CPCRs include Angiopoietin-like (ANGPTL) proteins (e.g., human Angiopoietin-1, Angiopoietin-2, and Angiopoietin-4). In aspects, PCMs block ILT2 pathway(s) and exhibit DOS NKC IRs, e.g., DOS enhanced IFN-γ production. In aspects, PCM(s) block inhibitor LIR/ILT pathway(s). In aspects, such PCMs are combined with heterologous PCMs. E.g., CEPs can comprise anti-LIR-1 PCMs and anti-NKG2A PCMs and such PCMs can DOS induce NKC IR(s).

2) Immunoglobulin Superfamily

In aspects, CEPs comprise PCM(s) that are of, are related to, or are modulators of immunoglobulin CPCR superfamily pathway(s). Examples of such CPCRs/modulators include CEACAM1 (self-ligand), CD96/CD155, and other examples described herein. In aspects, PCMs that modulate immunoglobulin CPCR superfamily pathways DOS induce IRs. In aspects, such PCMs comprise ligands of an activating immunoglobulin CPCR superfamily receptor, e.g., a Nectin-2/CD112 PPT or a CD48/BCM1 PPT.

In aspects, PCMs do not comprise any Nectin family PPTs that are bound by gDPs in CEPs. E.g., in an aspect, a CEP comprises a Nectin-2/CD112R PPT PCM and no gDPs that exhibit significant binding to Nectin-2. In aspects, PCMs do not comprise Nectin family PPTs. In aspects, such PCMs do not comprise PCMs that modulate both activating & inhibiting CPCR pathways (e.g., Nectin-2 and PVR).

(a) LAIR CPCR Family Pathway Modulators

In aspects, OSMGAOA PCM(s) in a CEP modulate a LAIR Family CPCR checkpoint pathway. Examples of such CPCRs include LAIR1, LAIR2, CD96, CD155/PVR, CRTAM, DNAM-1/CD226, PVRIG, and TIGIT. Nectin and Nectin-like Ligand/Receptor Co-Signaling Molecules, Nectin-2/CD112, and Nectin-3 also have been associated with the LAIR family and checkpoint pathways (e.g., Nectin-2/PVR/CD112R, is a ligand for TIGIT, a well-established CI). Nectin-4 also has been associated with possible CI functions. In aspects, CEPs comprise one or more PCMs that are or modulate a LAIR CPCR Family pathway, such as targets described here. In aspects, CEPs do not comprise any Nectin PPTs that are bound by gDPs In aspects, PCMs do not include Nectin PPTs. In aspects, PCM(s) bind Nectin PPTs. In aspects, PCMs in CEPs do not include Nectin-binding PCMs.

CD112/CD112R (PVR/Nectin-2)

In AOTI, PCM(s) modulate the CD112R CPCR pathway. In aspects, PCM(s) block CD112R-CD112 interactions. In aspects, such PCMs DOS enhance TC activity. In aspects, such PCM(s) are Abs or Ab FPs. In aspects, such PCMs are non-Ab FPs. Non-Ab FP CD112R CIs can comprise soluble CD112/Nectin-2/PVRL2 PPTs. In AOTI, non-Ab FP CD112 PCMs are CD112R trap PPTs. In AOTI, PCM modulators of the CD112R/CD112 pathway DOS enhance IC IFN-γ- or IL-17 production. In AOTI, CEPs comprising such PCMs exhibit DOS recruitment/concentration or IRs mediated by DCs, monocytes, or both.

In aspects, a Nectin-2 PCM exhibits T cell stimulation effects. In aspects, a CEP comprises both Nectin-2 PPT(s) and CD155/PVR/Necl-5 PPT(s) and DOS stimulate T cells. In such aspects, PCMs can further comprise PPTs that block CD112R, TIGIT, or both.

In aspects, CEPs comprise PCMs that block both CD112R and TIGIT. Modulation of CD112R & TIGIT is described in, e.g., Xu F et al. Cancer Immunol Immunother. 2017; 66(10): 1367-1375.

Aspects of such CIs that can be adapted to these AOTI are discussed in, e.g., Zhu Y, Paniccia A, Schulick A C, et al. J Exp Med. 2016; 213(2):167-176. A CD112R epitope AVLHPERGIRQWAPARQ (SEQ ID NO:732) can be bound by CD112R-modulating PCMs, as described in US20170240613A1.

TIGIT and CD96 CPCR Pathway Modulators

In aspects, CEPs comprise PCMs that modulate a TIGIT (T cell immunoreceptor with immunoglobulin and ITIM domains) pathway or a CD96 pathway. In aspects, PCM(s) block TIGIT pathway(s). In aspects, PCM(s) activate CD96 pathway(s).

In aspects, PCMs DOS inhibit CD155 binding to TIGIT, In aspects, such PCMs can DOS exhibit enhanced CD155 (PVR) binding to activating CPCR CD226. In aspects, PCMs block CD155/PVR interactions. In aspects, PCMs block all three of PVR, TIGIT, and CD96 from interactions. In aspects, PCMs that block TIGIT pathway(s) exhibit DOS IRs in NKCs, T-cells (e.g., CTLs), or both. In aspects, such PCMS DOS reduce T-cell exhaustion. In aspects, such PCMs DOS induce enhanced cytokine production (e.g., IFNg or TNF-alpha). In aspects, such CEPs comprise anti-cancer Ags.

In aspects, PCM inhibitor(s) of TIGIT or combinations are Abs or AbFPs (antibody fusion proteins). Such Abs are known in the art (SFE Chen F et al. Cancer Med. 2020; 9(10):3584-3591) and anti-TIGIT Abs are commercially available. In aspects, such inhibitors are non-Ab ligands, such as multimeric trap PPTs. In aspects, CEPs comprising OSMOA of such PCMs also include PCM(s) that block PD-1 pathway(s).

In aspects, PCM(s) comprise CD96 PPTs or activators of a CD96 pathway. In aspects, such PCMs DOS enhance T cell IRs (e.g., T cell differentiation or cytokine levels).

In aspects, PCM(s) comprise CD226 activating PCMs.

(b) TIM CPCR Family Pathway Modulators

In aspects, CEPs comprise modulators of a TIM CPCR pathway (e.g., TIM-1/KIM-1/HAVCR, TIM-3, Galectin-9, HMGB1, CEACAM-1, TIM-2, H-ferretin, Semaphorin 4A, and TIM-4. In aspects, CEPs comprise PCM(s) that modulate the TIM-3 3 (T-cell immunoglobulin and mucin domain 3) pathway. In aspects, PCM(s) comprise TIM-3 ligands. In aspects, TIM-3 ligand(s) comprise TIM-3 Abs or Ab FPs (such Abs are known—e.g., Sym023, Cobolimab, LY3321367, BGB-A425, and MBG453). In aspects, TIM-3 ligand(s) comprise TIM-binding traps. In aspects, TIM-3 ligands comprise Galectin-9, HMGB1, or CEACAM-1 PPTs. In aspects, such CEPs exhibit DOS IRs in DCs, T-cells, NKCs, NKTCs, myeloid cells, or combinations.

(c) SIRP CPCR Family Modulators

In aspects, PCM(s) comprise modulator(s) of a SIRP CPCR family receptor pathway. Examples of such CPCRs include signal regulatory protein-α (SIRPα or SIRPa—a.k.a. CD172a). Other SIRP CPCRs include SIRP beta1, SIRP beta2, and SIRP gamma. CEPs comprising PCM(s) that modulate 1+ of such pathways are an aspect of the invention. In aspects, PCM(s) inhibit a SIRP CPCR, e.g., binding to the CPCR, its ligand (CD47, another CPCR), or both. Such PCM(s) can be anti-SIRP or anti-CD-47 Abs or Ab FPs. Such Abs are known in the art (e.g., Magrolimab (Hu5F9-G4) is a known anti-CD47 Ab). Such PCMs can be SIRP-binding trap PPTs. In aspects, such PCM(s) induce DOS IRs in DCs, macrophages, or both. In aspects, such PCMs DOS promote DCA-associated cell phagocytosis. In aspects, such PCMs DOS enhance NKC activity. Such CPCRs are described in, e.g., Li C W et al. Front Med. 2018; 12(4):473-480.

(d) KIR CPCR Family Modulators

In aspects, CEPs comprise modulator(s) of KIR (killer cell immunoglobulin-like receptors) Family CPCR(s). KIR CPCRs include inhibitory KIR2DL1, KIR2DL2, & KIR2DL3 CPCRs. Other KIRs are activating CPCRs. In AOTI, PCM(s) are modulator(s) of inhibitor KIR(s). In aspects, PCM(s) are modulator(s) of activating KIR(s). In AOTI, PCMs comprise anti-KIR Abs or Ab FPs, anti-KIR-ligand Abs or Ab FPs, or CT. Examples of such Abs are described in, e.g., US20120208237 or are KITA (e.g., Lirilumab (1-7F9, IPH2101)).

(e) Natural Cytotoxicity Receptor Pathway Modulators

In aspects, CEPs comprise PCM(s) that modulate a natural cytotoxicity receptor (NCR) pathway. NCRs are classified as NKp46, NKp44, or NKp30 CPCRs, but isoforms of such CPCR(s) can exist with different properties. E.g., NKp30 isoforms NKp30a and NKp30b evoke NKC activation, the NKp30c isoform was shown to elicit secretion of the immunosuppressive cytokine, IL-10 from NKCs. As suggested by the preceding, NCRs comprise both activating and inhibiting CPCRs and, accordingly, PCMs can block inhibitor NCR pathway(s), induce activating NCR pathway(s), or both. Some NCRs, e.g., NKp44-1, exhibit situational inhibition/activation dependent upon association with other PPTs, notably the STAP DAP12 (which leads towards NKp44-1 activation of IR(s), particularly in NKCs). In aspects, PCMs comprise modulators of at least 2 NCRs. In aspects, PCMs comprise ≥1 NCR modulating PCM and ≥1 heterologous PCM, such as a PD-1 pathway blocking PCM. In aspects, PCM(s) block inhibitor NCR(s), ligand(s) of such NCRs, or both. Ligands of inhibitory NCRs are known and include B7-H6 PPTs, Nidogen-1 PPTs, and Galectin-3 PPTs. In aspects, PCM(s) comprise Abs or Ab FPs against such ligand, inhibitory NCRs, or both. In aspects, PCM(s) comprise ligands of activating NCRs, such as PDGF-DD PPTs or agonistic Abs against such CPCRs. DCA-associated PPTs, such as influenza HA/HN PPTs also have been shown to modulate NCRs and can be used as PCMs, Ags, or both. Aspects of such ligands and modulation of NCRs is known and such knowledge can be applied to AOTI (SFE Barrow A D et al. Front Immunol. 2019; 10:909. Published 2019 May 7 and Kruse P H et al. Immunol Cell Biol. 2014; 92(3):221-229). In aspects, PCMs include an ITICSTAP that promotes activation of an activating NCR, e.g., a DAP12 PPT (a WT PPT, FF, or FV). In aspects, CEPs comprise ITICITMs that are NCR modulators or PPTs that can act as both ITICIMs and as cell surface PPTs or PPTs that modulate such PPTs (e.g, intrabodies against such targets in the case of inhibitory ITICITMs. Intracellular ligands modified by NCRs include HLA-B-associated transcript 3 (BAT3), proliferating cell nuclear antigen (PCNA), internal Ag(s) such as HIV gp41, mixed-lineage leukemia protein-5 (MLL5), and NKp44L and PCMs can comprise either such PPTs or modulators thereof (e.g., blocking intrabodies).

(f) SLAM CPCR Family Modulators

In aspects, CEPs comprise PCM(s) that modulate a pathway of a signaling lymphocyte activation molecule (SLAM) CPCR family. Examples of SLAM CPCRs include SLAM/SLAMF1, CD48/SLAMF2, CD58/LFA-3, CD229/SLAMF3, 2B4/CD244/SLAMF4, CD84/SLAMF5, NTB-A/SLAMF6, CRACC/SLAMF7, BLAME/SLAMF8, CD2F-10/SLAMF9, and CD2. PCM(s) can modulate any aspect of such pathway(s). Additional SLAMF members & related PPTs are discussed elsewhere and are described in, e.g., O'Connell P et al. Vaccines (Basel). 2019; 7(4):184. Published 2019 Nov. 16. doi:10.3390/vaccines7040184. Most SLAM ICRs (SLAMF, 3, 5, 6, & 7) are self-ligands (SLAMF2 and SLAMF4 are ligands for each other). The use of such PPTs and related ESs (and the same WRT other SLAM ICR modulators) as PCM(s) is an AOTI. In aspects, OSMGAOA of PCM(s) in CEPs are adaptor(s) of a SLAM receptor. In aspects, OSMGAOA SLAM receptor adaptors (SLAMRAs) contain SH-2 motif(s), contain cytoplasmic ITIMs, are tyrosine phosphorylated PPTs, or exhibit combinations. In aspects, such CEPs induce DOS IRs in NKCs, CD8+ T cells, NKT cells, γδ T cells, monocytes, basophils, eosinophils, DCs, thymocytes, basophils, macrophages, B cells, or mast cells, or combinations.

In aspects, PCM(s) comprise a SLAM4 pathway PCM and one or more anti-viral Ags. In aspects, PCM(s) are SLAMF5 modulators. In aspects, such PCM(s) DOS induce enhanced IL-1p, IL-23, or IL-12 expression. In aspects, such CEPs comprise anti-viral Ags. In aspects comprising SLAM4 pathway or SLAM5 pathway PCMs, IRs can comprise DOS reduction of T cell exhaustion. In aspects, CEPs comprising viral Ag(s) comprise PCMs that block the SLAMF1 pathway, SLAMF3 pathway, or both. In aspects, any of such CEPs DOS enhance IFNg expression, DC activity (e.g., IL-12 or IL-8 secretion), B cell activity, NKC cytotoxicity, T cell activity, or CT. In AOTI, CEPs comprise PCMs that DOS modulate 2+ SLAM CPCR pathways (e.g., SLAMF7 and SLAMF5).

In aspects, PCMs are STAP(s) that modulate a SLAM receptor that is regularly expressed in DCs (SLAMF, SLAMF2, SLAMF3, SLAMF5, SLAMF6, SLAMF7, & SLAMF9). In aspects, PCMs are STPAP(s) that modulate SLAM1, SLAM2, SLAMF5, SLAMF7, SLAMF8, or SLAMF9, which are associated with higher levels in DCs. In aspects, PCM(s) are STAP(s) that modulate SLAM(s) in NKC(s) (e.g., SLAMF4) or both NKCs & DCs (SLAMF2, SLAMF3, SLAMF5, SLAMF7, or SLAMF8). SLAM-associated STAP PCMs are discussed elsewhere here and, e.g., Veillette A. Immunol Rev. 2006; 214:22-34; Cruz-Munoz, M., et al. Nat Immunol 10, 297-305 (2009); and Tassi I et al. J Immunol Dec. 15, 2005, 175 (12) 7996-8002. In aspects, PCM(s) comprise both SLAM CPCR-modulating STAP(s) (e.g., SAP PPTs or EAT-2 PPTs) and SLAM CPCR extracellular ligand(s) (e.g., CRACC PPTs). In aspects, OSMGAOA SLAM pathway modulator(s) in CEPs are SLAM CPCR STAP(s), e.g., EAT-2 PPTs. In aspects, CEPs comprise PCMs that block SLAMF7 inhibition of ICs, such as TCs (e.g., PPTs that block SLAMF7 inhibitory pathway modulators that are specific to T-cells and not expressed in significant amounts in DCs). In aspects, PCM(s) comprise modulators of SLAM STAP(s), such as PPTs that bind and block the functioning of EAT-2 PPTs, SAP PPTs, or both.

In aspects, SLAM pathway PCM(s) comprise anti-SLAM or anti-SLAM ligand Abs or Ab FPs. In aspects, Ab FPs comprise Fc domains. An example of such an Ab FP is a CRACC-Fc FP described in references cited herein. Anti-SLAM Abs that induce IRs are known and include, e.g., Elotuzumab (SFE Pazina T et al. Oncoimmunology. 2017; 6(9):e1339853. Published 2017 Jun. 16; Aldhamen Y A et al. Vaccine. 2016; 34(27):3109-3118; and Malaer J D et al *Am J Cancer Res.* 2017; 7(8):1637-1641). In aspects, SLAM pathway PCM(s) are non-Ab PPTs. In aspects, SLAM pathway PCM(s) are multimeric trap proteins (e.g., a SLAM7 trap, a SLAM4 trap, or a SLAM5 trap).

(g) Other Ig Family CPCR Pathway Modulators

In aspects, CEPs comprise other PCM(s) that modulate other immunoglobulin superfamily CPCR pathway(s) not associated with any of above-described family. Examples of such PCMs/pathways are described here.

LAG-3 Pathway Modulating PCMs

In aspects, PCMs comprise LAG-3 CMs. Lymphocyte activation gene 3 (LAG-3; also known as CD223) is known to modulate regulatory T cells (TRegs) and suppresses CD8 T cells. In aspects, PCMs block one or both LAG-3 effects. Such a PCM can bind and block LAG-3 or a LAG-3 ligand (e.g., Galectin-3, fibrinogen-like protein 1 (FGL1), or both). In aspects, PCMs also can modulate PPTs in a pathway that leads to expression or enhanced expression of an inhibitory checkpoint PPT, such as LAG-3 (this approach can be applied to any of the inhibitory checkpoint PPTs described in this disclosure). In AOTI, the EP comprises both a LAG-3 and a PD-1 or PDL-1 CI AARS or PPT. In AOTI, the presence of both types of CIs in the EP significantly enhances the immune response to the EP over either CI alone. In AOTI, the LAG-3 CI AARS or PPT comprises an anti-LAG Ab or anti-LAG Ab sequences. Examples of such Abs are described in WO2010019570; WO2008132601; and WO2004078928. In aspects, PCMs that block LAG-3 induce DOS IRs in DCs. In aspects, PCMs comprise a LAG-3 Ab FP. Eftilagimod alpha (IMP321), an example of such an Ab FP, is known, and has been shown to induce NKC cytokine production, sustain NKC activation, or both. In aspects, blocking the LAG-3 checkpoint pathway with PCM(s) DOS induces T-cell IRs. In aspects, CEPs comprise both LAG-3 blocking PCM(s) and PD-1 pathway blocking PCM(s). In aspects, such CEPs result in DOS reduction of T cell exhaustion in TRs. In aspects, CEPs comprise LAG-3 blocking PCM(s) and TIM-3 blocking PCM(s), B7-H1 blocking PCM(s), or both. In aspects, LAG-3 pathway blocking PCMs comprise PCMs that bind and block 1+ or 2+ LAG-3 ligands, bind and block LAG-3, or both. In aspects, CEPs comprising such PCMs comprise viral Ags, cancer Ags, or both.

CD200R/CD200AR Pathway Modulating PCMs

In aspects, CEPs comprise PCM(s) that modulate a CD200R CPCR pathway. In aspects, PCM(s) block a CD200R pathway. In aspects, such PCMs comprise anti-CD200R Abs or Ab FPs, anti-CD200 (OX2) Abs or Ab FPs, or both. Anti-CD200 Abs are known in the art (SFE Mahadevan, D et al. j. immunotherapy cancer 7, 227 (2019)). In aspects, CEPs comprising such PCM(s) induce IRs comprising DOS enhanced IL-2 expression, enhanced IFNg expression or both. In aspects, delivery of such CEPs induces DOS IRs in T-cells, NK cells, B cells, or combinations. In aspects, such CEPs comprise cancer Ag(s). In aspects, such CEPs induce DOS CEs comprising reduction of tumors, prolonging survival, and increasing survival rates.

In aspects, CEPs comprise PCM(s) that are CD200AR modulators (CD200AR is an activating CPCR; CD200R is an inhibitory CPCR). In aspects, such PCM(s) activate a CD200AR CPCR. In aspects, such a PCM is a ligand of CD200AR, such as a CD200AR-L. Such ligands are known in the art (SFE Olin M R et al. Cancers (Basel). 2019; 11(2):137 and Xiong Z et al. Clin Cancer Res. 2020; 26(1):232-241). In aspects, such a PCM is a multimeric trap.

Siglec CPCR Pathway Modulating PCMs

In aspects, PCM(s) modulate Sialic acid-binding Immunoglobulin-like lectins (Siglec) pathway(s). Such CPCRs include Siglec-2, Siglec-3, Siglec-5, Siglec-6, SIglec-7, Siglec-8, Siglec-9, Siglec-10, and Siglec-11.

In aspects, PCM(s) block Siglec-7 and Siglec-9 CPCR pathway(s). In such aspects, CEPs induce DOS NKC IR(s). In aspects, such CEPs comprise anti-cancer Ags.

In aspects PCM(s) block Siglec-2 pathway(s) or Siglec-3 pathway(s). In aspects such PCM(s) comprise anti-Siglec Abs/Ab FPs. Such Ab PPTs are known (e.g., Inotuzumab ozogamicin & Gemtuzumab ozogamicin). In aspects, such CEPs comprise CAgs.

3) TNF Superfamily Members

In AOTI, PCM(s) comprise modulators of TNF Superfamily CPCR pathway(s). In aspects, PCM(s) modulate death-domain-containing CPCR pathway(s). In aspects, PCM(s) modulate TNF family decoy receptor CPCR pathway(s). In aspects, PCM(s) modulate TNF receptor-associated factor (TRAF) binding receptor pathway(s). In aspects, PCM(s) comprise TRAF STAP(s) or PPTs that modulate TRAF signaling. In aspects, such PCM(s) are FP(s) comprising T-cell TS(s), CPPS(s), or both.

In aspects, PCM(s) comprise PPTs of or that modulate 4-1BB/TNFRSF9/CD137, 4-1BB Ligand/TNFSF9, BAFF/BLyS/TNFSF13B, BAFFR/TNFRSF13C, CD27/TNFRSF7, CD27 Ligand/TNFSF7, CD30/TNFRSF8, CD30 Ligand/TNFSF8, OX-40/TNFRSF4, OX40 Ligand/TNFSF4, glucocorticoid-induced TNFR-related protein (GITR, TNFRSF18), GITR Ligand/TNFSF18, CD27, CD40/TNFRSF5, CD40 Ligand/TNFSF5, DR3/TNFRSF25, TL1A/TNFSF15, HVEM/TNFRSF14, LIGHT/TNFSF14, Lymphotoxin-alpha/TNF-beta, RELT/TNFRSF19L, TACI/TNFRSF13B, TL1A/TNFSF15, or TNF RII/TNFRSF1B. BTLA/CD272 is sometimes associated with the TNF CDCR Superfamily and sometimes associated with the B7/CD28 family. TNFa, a cytokine, which can be included in CEPs, is also associated with TNF Superfamily CPCR pathways (e.g., CD27, CD70, CD30, and CD40L). In aspects, such PCM(s) DOS induce IR(s) in T cells, B cells, NK cells, monocytes, DCs, or combinations. In aspects, PCM(s) comprise GITRL PPTs or GITR activators and such PCM(s) DOS induce T cell effector activity or T cell proliferation, promote T cell survival, or suppress TReg activity. In aspects, PCMs comprise a CD70 PPT or an activator of CD27 and such PCMs DOS induce NKC survival or activation, induce T cell memory, or enhance B cell IR(s). In aspects, PCM(s) include CD154 PPTs or activators of CD40 CPCR(s), and such PCMs induce IR(s) in B cells. In aspects, PCM(s) include 4-1BBL PPTs or 4-1BB activators and such PCM(s) DOS induce IRs in NKCs, T-cells, or both (e.g., activation, survival, or effector functions). Examples of such activators (Ab and non-Ab PPTs, including 4-1BBL FVs) are known and can be adapted to expression in CEPESCs (SFE Claus C et al. Sci Transl Med. 2019; 11(496): eaav5989; Li Y et al. Cell Rep. 2018; 25(4):909-920.e4; and Vinay D S, Kwon B S. Immunotherapy of cancer with 4-1BB. Mol Cancer Ther. 2012; 11(5):1062-1070).

OX40 Pathway Modulating PCMs

In aspects, PCM(s) in CEPs modulate an OX40 pathway. In aspects, PCM(s) are OX40 agonists/activators. In aspects, such PCM(s) induce IR(s) comprising CD4 and CD8 T-cell priming, proliferation, and function; reduction of TReg inhibition of CD8 T cells; neutrophil activation or survival; or combinations. In aspects, such PCMs comprise agonist Ab/Ab FPs. Agonist OX40 Abs are known in the art (OX86, see Jin H et al. JCI Insight. 2019; 4(21):e129736). In aspects, such PCMs comprise OX40L PPTs (e.g., WT OX40L PPTs, FFs, or FVs). In aspects, such PPTs are OX40 trap PPTs. In aspects, such PCMs DOS induce enhanced immunological memory.

HVEM/BTLA/LIGHT Pathway Modulating PCMs

In aspects, PCM(s) modulate HVEM/BTLA/Light pathway(s). In aspects, as discussed elsewhere, gDPs bind HVEM. In such aspects, PCM(s) can or can not also include HVEM/BTLA/LIGHT modulating PCMs. In aspects, such PCM(s) are not included in CEPs. In aspects, CEPs do not comprise HVEM-binding gDPs, but comprise HVEM/BTLA/Light pathway modulating PCM(s). Such PCMs are known in the art (SFE WO2010006071A1). Anti-HVEM Abs are described in, e.g., Heo S K et al. J Leukoc Biol. 2006; 79(2):330-338. HVEM fragment peptides that block HVEM pathway(s) that can be adapted for use as PCMs are described in Spodzieja M et al. PLoS One. 2017; 12(6): e0179201.

4) C Lectin Family Members

In aspects, PCM(s) modulate C Lectin Family CPCR pathway(s). In aspects, PCM(s) modulate dectin-1 cluster CPCR(s) (e.g., dectin-1, CLEC-1, CLEC-2, LOX-1, CLEC12b, CLEC9a, or combinations). In aspects, PCM(s) modulate dectin-2 cluster CPCR(s) (e.g., dectin-2, blood DC antigen 2 (BDCA-2), DC immunoactivating receptor (DCAR), DC immunoreceptor (DCIR), CTL superfamily 8 (CLECSF8), and MINCLE (CLEC4E)). As also DEH, different species express homologs of such PPTs that are within the scope of such AOTI. In aspects, such PCM(s) induce IRs in ICs, such as ITICs.

(a) NKG2A and CD94 ITIIs

In aspects, PCM(s) include modulators of an NKG2A/CD94 pathway. In aspects, PCM(s) inhibit NKG2A or an NKG2A-related pathway. In aspects, such PCM(s) comprise Abs or Ab FPs. Anti-NKG2A/CD94 Abs are known in the art (e.g., IPH2201-Monalizumab—Innate Pharma) and can be adapted for expression in PCM(s) as Abs, Ab fragments, Ab variants, or FPs of any thereof. As with any other PCM described here, in such aspects, additional, heterologous PCM(s) are in CEPs with NKG2A/CD94 modulating PCMs (e.g., PD-1 pathway blocking PCM(s) or anti-CD20 PCMs). In aspects, such CEPs further comprise CAg(s). In such aspects, such CEPs can include CEs including, e.g., enhanced cancer progression-free survival, median overall survival, or both.

(5) PCM(s) of Other CPCR Pathways

PCMs are not limited to modulation of any particular pathway and, as noted, the above-described groups and classifications of pathways/CPCRs are debated, in flux, and expanding. Examples of other CPCRs/pathways that can be modulated by PCM(s) and that are not readily classified with the above-described groups include CD7, CD160, CD300a/LMIR1, CD300d, CD3001h, DPPIV/CD26, EphB6, Integrin alpha 4 beta 1, Integrin alpha 4 beta 7/LPAM-1, TSLPR, and inhibitory CPCR adenosine A2a receptor (ADORA2A) (and its ligands TDO or IDO1). In aspects, PCM(s) modulate these/other CPCRs/pathways x. Non-Checkpoint Modulating IM Peptides/AARSs (NCMIMPs)

In aspects, PIMs comprise peptidic IMs that are not typically classified as CMs. CEPs can comprise any suitable number and type of such additional IM PPTs and CCCs and AAWs can include both peptidic and non-peptidic IMs that are not typically classified as CMs. Examples of such non-CM IM PPTs (NCMIMPs), such as cytokines & alarmins, are briefly described here.

a. Cytokines

In aspects, CEPs, AACs, or CCCs comprise cytokine(s). E.g., in aspects CEP(s) comprise chemokine(s), interferon(s) (IFN(s)), interleukin(s) (ILs, e.g., IL-2), lymphokine(s), tumor necrosis factor(s) (TNFs), or CT.

Typically, hormones and most growth factors are not considered cytokines. CEPs can comprise peptidic hormones, growth factors, or both that act as IMs and AACs/CCCs can comprise both peptidic and non-peptidic IM hormones or growth factors or hormones or growth factors that otherwise induce favorable CEs.

In aspects, cytokine(s) in PCMs are or are related to PPTs primarily expressed in ICs; regulate maturation, growth, and responsiveness of IC populations; are typically upregulated in response to infection, inflammation, trauma, sepsis, or cancer in TRs; typically circulates in larger vertebrates, such as humans, in picomolar concentrations, but in some aspects exhibit an at least 100×, at least 250×, at least 500×, or at least 1000× increase in healthy TRs in response to trauma or infection; is expressed in multiple organs/tissues of a subject, rather than primarily, generally only, or only in a single gland, such as the pancreas; exhibit detectable systemic effects or favor systemic over localized effects in a subject (but some cytokines such as IL-6, IL-8, and IL-12 exhibit relatively localized effects); or CTs (2+, 3+, 4+, or all thereof). These and other characteristics can distinguish cytokines expressed in CEPs from non-cytokine hormones (classical hormones). However, many cytokines, like a classical hormone, can be autocrine or paracrine in nature, and can induce chemotaxis, chemokinesis, endocrine functions, & pyrogenic responses.

Cytokines are sometimes further classified, e.g., as interleukins (e.g., IL-2, IL-7, and IL-12) and chemokines (e.g., CCL3, CCL26, and CXCL7), based on their presumed function, cell of secretion, or target of action. Cytokines expressed in immune cells are sometimes called lymphokines (e.g., GM-CSF and IFN-γ (IFNg)). Cytokines also or alternatively are sometimes classified as those that induce cellular immune responses (type 1—e.g., TNFα, IFN-γ, etc.), and type 2 (e.g., TGF-β, IL-4, IL-10, IL-13, etc.), which favor antibody responses. Finally, cytokines and immune cells can be classified as level 1 (early), level 2 (intermediate), or level 3 (late), with respect to when the cytokine/immune cells become primarily involved in a typical immune response. Level 1 cytokines include IL-12, IL-23, IL-6 and IL-1β for the type 1 immune responses, and TSLP, IL-25, IL-33 and IL-1α for the type 2 immune responses and can act on type 2 cells (e.g., ILCs, innate-like lymphocytes (ILLs; including NKT cells, MAIT cells and epithelial γδ T cells), TFH cells and TRM cells), which produce type 2 cytokines (e.g., IFN-γ, IL-17, IL-22 for type 1 immune response, and IL-4, IL-5, IL-9, IL-13 and AREG for type 2 immune response) (note that IL-21 is common to both). Level 2 cytokines typically act on level 3 cells, which include effector cells (e.g., macrophages, neutrophils, epithelial cells, eosinophils and basophils, and B cells (e.g., B-2 cells)). Naive T cells can become the source of level 2 cytokines after activation and differentiation into effector or memory cells. ILCs that lack TCRs, ILLs that have invariant TCRs, and TRM cells that have many features in common with ILCs and ILLs, either do not need to undergo proliferation and differentiation steps (ILCs and ILLs), or have already done so in the past (TRM cells). SFE Iwasaki A et al. Nat Immunol. 2015; 16(4):343-353. CEPs can comprise any such cytokine(s) or FFs/FVs thereof.

Cytokine AARSs and PPTS in ES can exhibit one or more immunomodulatory effects in targeted cells or subjects. In AOTI, a cytokine EPs promote proliferation of NK cells, promote activation of NK cells, promote proliferation of CD8 T cells, promote activity of CD8 t cells, promote survival of CD4 T cells, promote survival of CD8 T cells, promote survival of memory T cells, promote proliferation of B cells, promote proliferation of NKT cells, promote differentiation of immune cells, promote maturation of immune cells, inhibit proliferation of TRegs, promote survival of NK cells, promote T cell differentiation, promote monocyte recruitment, promote secretion of other cytokines by immune cells (e.g., IFN-γ), enhance antibody effectiveness (and often bind antibodies), enhance local or systemic inflammation, or result in a detectable or significant combination of any or all thereof in a subject or competent cell-containing composition.

In AOTI, CEPs comprise ≥1, ≥2, or ≥3 cytokine PPTs. In AOTI, EP comprises 2+ cytokine AARSs or PPTs. In AOTI, one, some, most, generally all, or all of any cytokine AARSs in a CEP are contained in one or more gDAgFPs. In AOTI, EP comprises only one cytokine PPT/AARS. In AOTI, CEPs lack any cytokine PPTs/AARSs.

Exemplary cytokine PPTs and AARSs that can be included in CEPs include IFNγ, IL-2, IL-4, IL-6, IL-7, IL-10, IL-12, IL14, IL-13, IL-15, IL17, IL-18, IL20, IL21, IL-23, IL-24, IL-27, IL-28a, IL-28b, IL-29, KGF, TNF, TGF, GMCSF, MCSF, OSM, IFNα (e.g., INFα2b), IFNβ, GM-CSF, CD40L, Flt3 ligand, stem cell factor, ancestim, and TNFα (SFE Dranoff, Nat Rev Cancer. 2004 January; 4(1): 11-22 and Szlosarek, Novartis Found Symp. 2004; 256:227-37; discussion 237-40, 259-69). Suitable chemokine AARSs and PPTs in EPs can include Glu-Leu-Arg (ELR)-negative chemokines such as IP-10, MCP-3, MIG, and SDF-1 alpha from the human CXC and C-C (or CC) chemokine families, such as MIPalpha, MIPbeta, MCP-1, IL-8, GROalpha, and IP-10. CEPs also or alternatively can comprise AARSs or PPTs that are chemokines, such as RANTES, MIP-1α, Flt-3L (U.S. Pat. Nos. 5,554,512; 5,843,423) and the like. Suitable cytokines also or alternatively include cytokine variants, cytokine fragments, and cytokine fusion proteins of any thereof. Peptidic cytokines and cytokine-related compounds can also or alternatively be included in combination therapy methods, combination prophylaxis methods, and combination compositions, further discussed below. Numerous other cytokines and cytokine-related compounds that can be used in CEPs or as combination product/method agents are described in the various references cited herein. In aspects, cytokine(s) in CEPs or ACCs/CCCs DOS induce NKC functions (such cytokines, e.g., IL2, IL12, IFNg, and IL21, are described in, e.g., Wu Y et al. Front Immunol. 2017; 8:930.

b. Alarmins, Stressorins, and Defensin PPTs and Modulators

In aspects, CEPs comprise alarmin PPT(s), stressorin PPT(s), or both; modulators of alarmin/stressorin pathway(s) (e.g., of a receptor thereof), or combinations. Alarmins and stressorins are compounds that induce physiological effects in TRs including IRs. In general, alarmins/stressorins are similar to cytokines and some cytokines are classified as alarmins (e.g., IL-1α, IL-33, and IL-16). Other peptidic alarmins include high-mobility group box 1 protein (HMGB1), and the Ca2+-binding S100 proteins. In aspects, CEPs comprise ≥1 or ≥2 of such PPTs (or FFs or FVs thereof).

Alarmins can be distinguished from other cytokines by (1) being expressed in response to general stress in TRs vs. specific IC activation, (2) often being activated/modulated and exerting CEs/IRs upon/through post-transcriptional modification/cytoplasmic shuffling as opposed to de novo synthesis, and (3) often acting through inactivation processes or passive release/secretion as opposed to active secretion/processing associated with most cytokines. Other PPTs that are associated with TR inflammation and IRs in an alarmin-like manner and that can be included in CEPs include heat-shock proteins (HSPs) (DEH), adenosine triphosphate (ATP), nucleosomes, and mitochondrial components. As noted, alarmins typically are dual function PPTs, being present in a resting state inside the cell, typically in the nucleus, and being released from cells in response to stress. Alarmins are typically dual function PPTs and expressed in somatic cells. Alarmins are often released in response to cellular necrosis. Stressorins, which are either alarmins or a subclass of alarmins, also are expressed by somatic cells, but are more likely to be actively secreted in innate immune cell responses in a manner similar to alarmins. The characteristics of alarmins and stressorins are described in, e.g., Rider P. et al. J Immunol Feb. 15, 2017, 198 (4) 1395-1402. In aspects, CEPs comprise alarmin PPTs, stressorin PPTs, or both. CEP(s) can comprise any number of stressorin/alarmin PPT(s) including any suitable number of alarmin or stressorin AARS(s), which can be WT AARS(s) of complete alarmin/stressorin PPTs, FFs, or FVs thereof, or modulators of alarmin-related pathways that induce IR(s). Examples of alarmins and principles adaptable to this AOTI are described in Matta B M et al. Am J Transplant. 2017; 17(2):320-327; Yang D et al. Immunol Rev. 2017; 280(1):41-56; and Bertheloot D, et al. Cell Mol Immunol. 2017; 14(1):43-64.

In aspects, PIMs include a modulator of an alarmin receptor/PPT. Examples of such PPTs include DEC-205, TLR5, and HSP70. In AOTI, such PPTs or modulators thereof are expressed in CEPs as PIMs and induce IR(s) in TR(s).

In aspects, CEPs include defensin(s). Defensin(s) are effectors of the innate immune system with potent antibacterial, antiviral, or antifungal activity. Defensins have direct anti-pathogen DCA activity and some defensins exhibit potent immunomodulatory activity that can alter innate and adaptive IR(s), which naturally occurs in response to pathogen infection. Defensins are typically cysteine-rich cationic proteins that are smaller than cytokines. In aspects, CEPs comprise defensin(s) with direct anti-DCA activity, IC signaling, or both. Defensin PIMs can comprise a defensin PPTs (WT, FF, or FV), p defensins (WT, FF, or FV), or both. In aspects, CEPs comprise R defensin PPTs/AARs and such CEPs DOS induce DC migration. In aspects, ≥1 defensin AARs are expressed as FPs in CEPs (e.g., gDAgFP(s) in CEPs can comprise defensin AARS(s)). Defensins are KITA, SFE Yang D et al. Science. 1999 Oct. 15; 286(5439): 525-8; Holly M K et al. Annu Rev Virol. 2017; 4(1):369-391. doi:10.1146/annurev-virology-101416-041734; Zhao L et al. Curr Opin Hematol. 2014; 21(1):37-42; Ganz T. Nat Rev Immunol. 2003; 3(9):710-720; CN103614381; & U.S. Pat. No. 6,545,140. Any defensins described therein can be ATAOTI.

c. PIM Adjuvants

Another type of PIM that can be included in CEPs are PPTs/AARSs that can be characterized as adjuvants for the Ag(s) of the CEP. The term "adjuvant" in this respect is a catch-all for PIMs that induce non-specific immune responses and that either do not fit into other categories of PIMs or are classified in several categories (e.g., HSPs). Knowledgeable persons will recognize that, e.g., cytokines, CMs, alarmins, and the like also induce non-specific immune responses. As such, there can be overlap between these three "classes" of PIMs. Examples of PIMs that can be considered CEP adjuvants include TLRs, RIG-1, and NOD-like receptors and modulators thereof. CEPs can comprise any suitable number of PIM adjuvant (PIMA) PPT(s), AARS(s), or both. Such PIM adjuvant(s) induce DOS enhancement of antigen-specific IR(s) in TR(s). Other examples of PIM adjuvants that can be incorporated in CEPs include muramyl dipeptide, aminoalkyl glucosaminide 4-phosphates, such as RC529, and bacterial toxoids or toxin fragments. Other PIMs that can be in CEPs as AARSs or PPTs include cathelicidin and eosinophil-derived neurotoxin.

As is the case with cytokines and other compounds described herein, combination methods and combination compositions also or alternatively can include PIM adjuvants and other types of adjuvants, including lipid, glycan (e.g., beta glucan), or glycolipid (e.g., LPS) IMs/adjuvants, mineral preparations (e.g., alum), and other adjuvants. Additionally, as noted above, nucleotide sequences of constructs can provide immunogenic adjuvant properties, as in the case of CpG sequences. CCC/AAC adjuvants are also DEH.

HSPs can be classified as PIMAs or with other types of PIMs (e.g., alarmin-associated PPTs). Heat shock proteins (HSPs). In aspects, HSP AAARs are components of Ag FPs (e.g., CAg FPs). In aspects, PIMs comprise a HSP gp96/Ag(s) FP. An example of such a composition is HSP-protein complex 96 (HSPPC-96; vitespen). In aspects, a PIM comprises HSP65 PPTs/AARSs. In aspects, such AARSs are in Ag FPs. In aspects, such FPs comprise anti-pathogen or anti-cancer Ag(s), such as a HPV16 E7 Ag. PIMs can include chaperone proteins, such as gp96 (HSP90B1), which chaperones peptides generated by intracellular proteasome degradation into class I MHC; and (ii) can function as a danger-associated molecular pattern & activate DCs by binding to TLR-2 & TLR-4. Vabulas R M et al. J Biol Chem 2002; 277:20847-53.

In aspects, PIMs comprise an Fc receptor PPTs/AARSs, which can both be characterized as a component of an Ab FP or a PIM. In aspects, FPs comprising an Fc receptor AARS DOS induce ADCC in TRs.

In aspects, PIMs comprise PRRs or PRR modulators, e.g., Toll-like receptors (TLRs), nucleotide-binding oligomerization domain (NOD)-like receptors (NLRs) and RIG-I-like receptors (RLRs) and peptidic modulators thereof. In aspects, PIMs comprise flagellin PPTs/AARs.

PIMs can also comprise MHC molecules, fusion proteins comprising MHC molecules/sequences, or molecules that bind to MHC molecules. MHC II binding peptides are described in WO2012027365, WO2011031298, US20120070493,and US20110110965.

In AOTI, PIMs can be PPTs that modulate complement activity, such as blocking a completement inhibitor, such as CD46 or CD55 or an agonist for a completement receptor, such as CD21, a ficolin, or a related receptor modulator such as a modulator of CD19 or CD22. In AOTI, a PIM of an CEP comprises a pathogen-associated molecular pattern (PAMP)-related IM, such as a PAMP mimetic that is a PIM (e.g., a mimotope), a PRR modulator (e.g., a PRR agonist), or both. In aspects, a PIM comprises an AARS or PPT that is an opsonin or other macrophage function modulator such as CRP, SAA, or SAP, a collectin (e.g., surfactant protein-A), or a mannose-binding lectin (MBL) or Lipopolysaccharide-binding protein (LBP). In aspects, a PIM comprises a scavenger receptor related IM, such as an IM of CD36 or CD68. In aspects, a PIM of an EP is an alarmin PPT or comprises an alarmin AARS. In aspects, a PIM of an EP is a RAGE-associated IM (e.g., a HMGB-1 AARS/PPT or a different DAMP), which also can be characterized as an ITII.

Adjuvant AARSs/PPTs also can comprise chaperone(s), e.g., cytoplasmic chaperone PPT(s)/AARS(s), ER chaperone PPTs/AARSs, viral intercellular spreading protein(s), cytoplasmic translocation polypeptide domain of a pathogenic toxin, centrosome targeting AARS(s), lysosome-associated membrane protein type 1 or associated PPTs, or FFs or FVS thereof. PIM adjuvant(s) can comprise calreticulin (CRT), N-CRT, P-CRT, C-CRT, γ-tubulin, Sig/LAMP-1, VP22 or a functional homolog, FF, or FV of any thereof. As indicated here, any of the PIM adjuvants described herein can be incorporated into FPs with other aspects of CEPs or can be expressed as NFP EPs.

As DEH, CEPs can comprise modulators of PPT pathway(s), such as ubiquitin pathway(s). E.g., CEPs can comprise ubiquitin ligase PPTs/AARs (e.g., E3 ubiquitin ligase PPTs/AARSs), or a ubiquitin-conjugating enzyme (e.g., E2).

d. Non-CPCR ICRMs and ICRLMs

In aspects, CEPs comprise modulators of ICRs (ICRMs), ICRLs (ICRLMs), or both that are not characterized as CPCRs, but that induce DOS IRs. Examples of such ICRs and ICRLs are also encompassed by other classes described herein, thus there can be overlap in this category with other categories. Examples of such ICRs include, e.g., Toll-like receptor (TLR) (e.g., TLR1, TLR2, TLR4, TLR5 or TLR6 or TLR3, TLR7, TLR8 and TLR9) and examples of such ICRLMs include peptidic modulators thereof. An example of such ICRLMs are LPS mimotopes that interact with TLR-4 and induce IR(s) (SFE Shanmugam A et al. PLoS One. 2012; 7(2):e30839). Inclusion of mimotopes that modulate TLRs and other ICRs in CEPs is an AOTI. CEPs can comprise modulators or PPTs of leucine-rich repeat-containing receptors (NLRs), NOD-Like receptors, RIG-I-like receptors (RLRs), or AIM-2 like receptors. In aspects, such PPTS are Abs or Ab FPs. In aspects, such Ab/Ab FPs are multi-specific (e.g., are TRiKE or BiKE PPTs). These and other PIMs can include, e.g., cytokine receptor modulators and modulators of other ICRs that lead to DOS induction of IR(s).

e. Immunosuppressive IMs

In aspects, CEPs comprise immunosuppressive PIMs. In aspects, CEPESCs AAW immunosuppressive AACs. In aspects, CEPs do not comprise any immunosuppressive PIMs. In aspects, CEPESCs are not AAW immunosuppressive AACs. Immunosuppressors comprise compositions that reduce, inhibit, delay, diminish, or otherwise suppress ("suppress") IR(s). Typically, in aspects where CEPs comprise immunosuppressive PIM(s), CEPESCs are in CCs with immunosuppressor(s), or CEPESCs are AAWs immunosuppressor(s), the immunosuppressor(s) suppresses only certain IRs and does not DOS inhibit OSMOA IRs, does not DOS inhibit OSMOA CEs, or both. E.g., an immunosuppressor may inhibit IRs associated with cytokine overproduction (e.g., TH2 cytokine overproduction), so as to avoid cytokine storm (cytokine release syndrome) issues, while not inhibiting TH1 responses.

xi. Other IR-Enhancing Expression Products (IREEPs)

In aspects, CEPs comprise EPs that are not categorized into any of the above-described aspects but that are AW induction/enhancement of IR(s) in TR(s) or that can be characterized into other useful categories of PPTs. Examples of such EPs are discussed here.

E.g., in aspects CEPs comprise activating PI3K(s), such as the p110δ isoform (p110δ-PI3K), Class I PI3K. In aspects, CEPs comprise mammalian target of rapamycin (mTOR) PPTs. In aspects, CEPs comprise AKT PPTs. In aspects, CEP(s) comprise inhibitors of PTEN, SHIP, or both. In aspects, CEP(s) comprise VAV PPTs, e.g., Vav1, Vav2, or Vav 3 PPTs.

In aspects, CEP(s) comprise PPTs that block/inhibits Bruton's tyrosine kinase (BTK); growth arrest specific 6 (Gas6); receptor-interacting serine/threonine kinase 1 (RIPK1); an inhibitory DAG kinase (DGK) such as DGKζ; or Janus kinase 2/signal transducer and activator of transcription 3 (Jak2/Stat3). In aspects, CEP(s) comprise TLR agonists (in aspects, such CEP(s) also comprise PD-1 PCI(s), e.g., anti-PD-L1 trap proteins or Abs).

In aspects, CEP(s) comprise FP(s) with NGD NKC ICR-binding domain(s). Examples of NKC IRs are DEH.

In aspects, CEPs comprise DAMPs, such as, e.g., calreticulin, HSPs (e.g., HSP70 or HSP90 PPTs), secreted amphoterin (HMGB 1), or ATP PPTs. In aspects, CEP(s) comprise hsc70, hsp110, grp170, or gp96 PPTs. In aspects, such PPTs are FPs. E.g., in aspects, a calreticulin (CRT) AARS acts as a TS in FPs in CEPs. As DEH, other PPTs discussed here can also be characterized as adjuvants & expressed in CEPs as part of FPs or as NFP PPTs (e.g., HSPs).

In aspects, CEPs comprise innate IC IMs, e.g., anti-CSF1 PPTs, which can DOS promote development of M1 macrophages (e.g., anti-cancer macrophages). mAbs targeting CSF1R have also been generated (FPA008, Five Prime Therapeutics; emactuzumab, Hoffmann-La Roche).

a. Innate Trained Immunity Immunomoduators (ITIIMs)

In aspects, CEP(s) comprise EP(s) that can be classified as innate trained immunity immunomodulator(s) (ITIIM(s)), either solely or in addition to other classes of EP(s) DEH (e.g., PCMs, ITICSTAPs, etc.). ITIIMs are immunomodulator(s) that exhibit significant induction of IR(s) in or through ITICs. In aspects, ITIIMs exhibit IR(s) in ITICs that are at least as great as IR(s) induced by the EP(s) in other ICs. In aspects, ITIIMs are limited to those EPs that predominantly, generally, substantially or only exhibit significant IR(s) in or through ITICs. Several EPs described herein are ITIIs (e.g., EAT-2 PPTs and SAP PPTs). In aspects, ITIIM(s) are FP(s) comprising a TS that direct(s) the FP to ITICs. In aspects, the FP directs the FP to DCs. In aspects, the TS binds DCs, other ICs, and non-ICs (in aspects, such an FP is a N1-binding gDFP). In aspects, the TS is more specific for DCs than other cells, other ICs, or both (e.g., the FP comprises a DEC-205-binding domain). In aspects, PIM portions of such FP(s) comprise PPTs that block ITIC (e.g., DC) associated IL-10 expression/secretion, block DC-associated IL-10R activity, block TGF-R binding/activity in ITICs/DCs, block IDO activity in DCs, block CCL22, block CCL17, block Bax apoptosis induction, block Bak apoptosis induction, comprise IL-12 PPTs, comprise MHCII PPTs, or combinations thereof.

In aspects, CEP(s) comprise chemokine(s) or related PPTs. Examples of such PPTs include macrophage inflammatory protein-1a (MIP-1a) and MIP-1b. In aspects, CEPs comprise IC-associated integrin PPTs or ligands, e.g., integrin-a4b1 PPTs or VCAM-1 PPTs. Other ITIIMs include TLR ligands/modulators such as TLR mimotopes.

B. Exemplary Expression Products

To better illustrate aspects of the invention, specific EPs will be described in this section, including exemplary gD domains, ITIIs, CIs, and Ags.

1. Antigenic PPTs and AARSs

CEPESCs and methods OTI can be applied to induce IRs against a variety of DCAs. In AOTI, the DCA is a pathogen, e.g., a virus. In aspects, a DCA is a cancer. The specificity of IR(s) associated with EP(s) will be primarily determined by the one or more Ags expressed or included in the EP, though the duration, level, and nature of the immune response will also be impacted by other elements of the EP, such as any associated targeting sequences and the inclusion of any CI AARSs or PPTs, ITII AARSs or PPTs, or both.

i. Pathogen Ags and Epitopes

In AOTI, the EP capable of eliciting an immune response against a pathogenic disease-causing agent (DCA). An EP can comprise any suitable number and type of pathogen Ags. In AOTI, some, most, generally all, or all of the Ags of an EP are directed to one type of pathogen. In aspects, some, most, generally all, or all of the Ags of an EP are from a pathogen that infects a target species. In AOTI, an EP comprises at least two pathogen Ags, such as at least one MHC I and at least one MHC II Ags against the same type of pathogen. In AOTI, some, most, or all of the Ags of an EP are contained in one or more fusion proteins, at least some, most, or all of which are gDAgFPs.

As discussed elsewhere, AgESs can comprise one or more modifications for improved expression (e.g., codon optimization or RNA optimization). An Ag also or alternatively comprise a fusion partner, such as an immunoglobulin leader sequence to increase the immunogenicity of the Ag FP or a cytokine. An Ag can also or alternatively be a synthetic Ag developed from a consensus sequence of several related DCA Ags.

Examples of Ags that can be encoded by AgESs in EPs include influenza Ags, such as nucleoprotein P, matrixprotein (M), and hemagglutinin (HA) Ags; *Plasmodium* Ags, such as thrombospondin-related anonymous protein, ring-infected erythrocyte surface antigen (RESA), merozoite surface protein 1 (MSP1), merozoite surface protein 2 (MSP2), merozoite surface protein 3 (MSP3), and glutamate-rich antigen (GLURP); and human papilloma virus (HPV) antigens, e.g., HPV-16 antigens, such as E5 protein, E6 protein, and E7 protein; and HIV antigens, such as gag, pol, nef, tet, and env.

In aspects, the DCA is one of the following pathogens: *leishmania*, *Entamoeba histolytica* (which causes amebiasis), *trichuris*, BCG/Tuberculosis, Malaria, *Plasmodium falciparum*, *Plasmodium malariae*, *Plasmodium vivax*, Rotavirus, Cholera, Diptheria-Tetanus, Pertussis, *Haemophilus influenzae*, Hepatitis B, Human papilloma virus, Influenza seasonal), Influenza A (H1N1) Pandemic, Measles and Rubella, Mumps, Meningococcus A+C, Oral Polio Vaccines, mono, bi and trivalent, Pneumococcal, Rabies, Tetanus Toxoid, Yellow Fever, *Bacillus anthracis* (anthrax), *Clostridium botulinum* toxin (botulism), *Yersinia pestis* (plague), *Variola major* (smallpox) and other related pox viruses, *Francisella tularensis* (tularemia), Viral hemorrhagic fevers, Arenaviruses (LCM, Junin virus, Machupo virus, Guanarito virus, Lassa Fever), Bunyaviruses (Hantaviruses, Rift Valley Fever), Flaviruses (Dengue), Filoviruses (Ebola, Marburg), *Burkholderia pseudomallei*, *Coxiella burnetii* (Q fever), *Brucella* species (brucellosis), *Burkholderia mallei* (glanders), *Chlamydia psittaci* (Psittacosis), Ricin toxin (from *Ricinus communis*), Epsilon toxin of *Clostridium perfringens*, *Staphylococcus* enterotoxin B, Typhus fever (*Rickettsia prowazekii*), other Rickettsias, Food- and Waterborne Pathogens, Bacteria (Diarrheagenic *E. coli*, Pathogenic Vibrios, *Shigella* species, *Salmonella* BCG/, *Campylobacter jejuni*, *Yersinia enterocolitica*), Viruses (Caliciviruses, Hepatitis A, West Nile Virus, LaCrosse, California encephalitis, VEE, EEE, WEE, Japanese Encephalitis Virus, Kyasanur Forest Virus, Nipah virus, hantaviruses, Tickborne hemorrhagic fever viruses, Chikungunya virus, Crimean-Congo Hemorrhagic fever virus, Tickborne encephalitis viruses, Hepatitis B virus, Hepatitis C virus, Herpes Simplex virus (HSV), Human immunodeficiency virus (HIV), Human papillomavirus (HPV)), Protozoa (*Cryptosporidium parvum*, *Cyclospora cayatanensis*, *Giardia lamblia*, *Entamoeba histolytica*, *Toxoplasma*), Fungi (Microsporidia), Yellow fever, Tuberculosis, including drug-resistant TB, Rabies, Prions, Severe acute respiratory syndrome associated coronavirus (SARS-CoV), *Coccidioides posadasii*, *Coccidioides immitis*, Bacterial vaginosis, *Chlamydia trachomatis*, Cytomegalovirus, Granuloma inguinale, *Hemophilus ducreyi*, *Neisseria gonorrhea*, *Treponema pallidum*, *Streptococcus mutans*, and *Trichomonas vaginalis*. DCAs from which pathogen Ags can be obtained for inclusion in EPs include, without limitation, influenza virus, HIV, cytomegalovirus, dengue virus, yellow fever virus, tick-borne encephalitis virus, hepatitis virus, japanese encephalitis virus, human papillomavirus, coxsackievirus, herpes simplex virus, rubella virus, mumps virus, measles virus, rabies virus, polio virus, rotavirus, respiratory syncytial virus, Ebola virus, Chikungunya virus, *Mycobacterium tuberculosis*, *Staphylococcus aureus*, *Staphylococcus epidermidis*, *E. coli*, *Clostridium difficile*, *Bordetella pertussis*, *Clostridium tetani*, *Haemophilus influenzae* type b, *Chlamydia pneumoniae*, *Chlamydia trachomatis*, *Porphyromonas gingivalis*, *Pseudomonas aeruginosa*, *Mycobacterium diphtheriae*, *Shigella*, *Neisseria meningitidis*, *Streptococcus pneumoniae* and *Plasmodium falciparum*.

Disorders that can be targeted by compositions and methods of the invention can include Legionnaires' disease (*Legionella*), gastric ulcer (*Helicobacter*), cholera (*Vibrio*), *E. coli* infections, staphylococcal infections, *salmonella* infections or streptococcal infections, tetanus (*Clostridium tetani*), protozoan infectious diseases (malaria, sleeping sickness, leishmaniasis, toxoplasmosis, i.e. infections caused by *plasmodium*, trypanosomes, *leishmania* and *toxoplasma*), diphtheria, leprosy, typhoids, pertussis, rabies, tetanus, tuberculosis, typhoid, varicella, diarrheal infections such as Amoebiasis, *Clostridium difficile*-associated diarrhea (CDAD), Cryptosporidiosis, Giardiasis, Cyclosporiasis and Rotaviral gastroenteritis, encephalitis such as Japanese encephalitis, Wester equine encephalitis and Tick-borne encephalitis (TBE), fungal skin diseases such as candidiasis, onychomycosis, Tinea captis/scal ringworm, Tinea corporis/body ringworm, Tinea cruris/jock itch, sporotrichosis and Tinea pedis/Athlete's foot, Meningitis such as *Haemophilus* influenza type b (Hib), Meningitis, viral, meningococcal infections and pneumococcal infection, neglected tropical diseases such as Argentine haemorrhagic fever, Leishmaniasis, Nematode/roundworm infections, Ross river virus infection and West Nile virus (WNV) disease, Non-HIV STDs such as Trichomoniasis, Human papillomavirus (HPV) infections, sexually transmitted chlamydial diseases, Chancroid and Syphilis, Non-septic bacterial infections such as cellulitis, lyme disease, tetanus, tuberculosis, MRSA infection, *pseudomonas*, staphylococcal infections, Boutonneuse fever, Leptospirosis, Rheumatic fever, Botulism, Rickettsial disease and Mastoiditis, parasitic infections such as Cysticercosis, Echinococcosis, Trematode/Fluke infections, Trichinellosis, Babesiosis, Hypodermyiasis, Diphyllobothriasis and Trypanosomiasisplague, Anthrax Nipah virus disease, Hanta virus, Smallpox, Glanders (*Burkholderia mallei*), Melioidosis (*Burkholderia pseudomallei*), Psittacosis (*Chlamydia psittaci*), Q fever (*Coxiella burnetii*), Tularemia (*Fancisella tularensis*), rubella, mumps and polio. Coccidioidomycosis and swine (H1N1) influenza, sepsis such as bacteraemia, sepsis/septic shock, sepsis in premature infants, urinary tract infection such as vaginal infections (bacterial), vaginal infections (fungal) and gonococcal infection, foodborn illnesses such as brucellosis (*Brucella* species), *Clostridium perfringens* (Epsilon toxin), *E. Coli* O157:H7 (*Escherichia coli*), *Salmonellosis* (*Salmonella* species), Shingellosis (Shingella), Vibriosis and Listeriosis, rabies, pneumonia, pneumonic plague, acute febrile pharyngitis, pharyngoconjunctival fever, epidemic keratoconjunctivitis, infantile gastroenteritis, Coxsackie infections, infectious mononucleosis, Burkitt lymphoma, acute hepatitis, chronic hepatitis, hepatic cirrhosis, hepatocellular carcinoma, primary HSV-1 infection (e.g., gingivostomatitis in children, tonsillitis and pharyngitis in adults, keratoconjunctitis), latent HSV-1 infection (e.g., herpes labialis and cold sores), primary HSV-2 infection, latent HSV-2 infection, aseptic meningitis, infectious mononucleosis, Cytomegalic inclusion disease, Kaposi sarcoma, multicentric Castleman disease, primary effusion lymphoma, AIDS, influenza, Reye syndrome, measles, postinfectious encephalomyelitis, Mumps, hyperplastic epithelial lesions (e.g., common, flat, plantar and anogenital warts, laryngeal papillomas, epidermodysplasia verruciformis), cervical carcinoma, squamous cell carcinomas, croup, pneumonia, bronchiolitis, common cold, Poliomyelitis, Rabies, bronchiolitis, pneumonia, influenza-like syndrome, severe bronchiolitis with pneumonia, German measles, congenital rubella, Varicella, and herpes zoster. As such, EPs can comprise 1+ Ags against any of the DCAs that cause such disorders.

a. Viral Ags & Epitopes

In AOTI, the DCA is a virus and the EP comprises one or more viral Ags. Examples of viral Ags that can be included in EPs include herpes virus Ag proteins, such as gH, gL gM gB gC gK gE or gD proteins or Ag fragments or herpesvirus Immediate Early (IE) proteins such as HSV-1 or HSV-2 ICP27, ICP 47, IC P 4, or ICP36 from HSV1 or HSV2; cytomegalovirus proteins (such as CMV gB or derivatives thereof); Epstein Barr virus proteins (such as EBV gp350 or derivatives thereof); Varicella Zoster Virus proteins (such as gpI, II, III and IE63), or from a hepatitis virus such as hepatitis B virus (for example Hepatitis B Surface antigen (HBSAg) or Hepatitis core antigen or pol), hepatitis C virus antigen and hepatitis E virus antigen, or Ags of other pathogenic viruses, such as paramyxoviruses: Respiratory Syncytial virus (such as F and G proteins or derivatives thereof), or antigens from parainfluenza virus, measles virus, mumps virus, human papilloma viruses (for example HPVG, 11, 16, 18, eg L1, L2, E1, E2, E3, E4, E5, E6, or E7), flaviviruses (e.g. Yellow Fever Virus, Dengue Virus, Tickborne encephalitis virus, Japanese Encephalitis Virus) or Influenza virus Ags (such as HA, NP, NA, or M proteins, or CT), or HIV Ags (such as tat, nef, gp120 or gp160, gp40, p24, gag, env, vif, vpr, vpu, or rev).

Viral Ag(s) can comprise 1+ Ags of a virus selected from Adenoviridae, Arenaviridae, Bunyaviridae, Caliciviridae, Coronaviridae, Filoviridae, Hepadnaviridae, Herpesviridae, Orthomyxoviridae, Papovaviridae, Paramyxoviridae, Parvoviridae, Picornaviridae, Poxviridae, Reoviridae, Retroviridae, Rhabdoviridae, or Togaviridae. Viral Ag(s) can be from papilloma viruses e.g., human papillomoa virus (HPV), human immunodeficiency virus (HIV), polio virus, hepatitis B virus, hepatitis C virus, smallpox virus (Variola major & minor), vaccinia virus, influenza virus, rhinoviruses, dengue fever virus, equine encephalitis viruses, rubella virus, yellow fever virus, Norwalk virus, hepatitis A virus, human T-cell leukemia virus (HTLV-I), hairy cell leukemia virus (HTLV-II), California encephalitis virus, Hanta virus (hemorrhagic fever), rabies virus, Ebola fever virus, Marburg virus, measles virus, mumps virus, respiratory syncytial virus (RSV), HSV-1, herpes simplex 2 (genital herpes), herpes zoster (varicella-zoster, a.k.a., chickenpox), cytomegalovirus (CMV), for example human CMV, Epstein-Barr virus (EBV), flavivirus, foot and mouth disease virus, chikungunya virus, lassa virus, arenavirus, lymphocytic choriomeningitis virus (LCMV), or cancer causing virus.

In aspects, an Ag is from a strain of virus selected from the group consisting of adenovirus strains; Herpes simplex, type 1; Herpes simplex, type 2; encephalitis virus, papillomavirus, Varicella-zoster virus; Epstein-barr virus; Human cytomegalovirus; Human herpes virus, type 8; Human papillomavirus; BK virus; JC virus; Smallpox; polio virus; Hepatitis B virus; Human bocavirus; Parvovirus B19; Human astrovirus; Norwalk virus; coxsackievirus; hepatitis A virus; poliovirus; rhinovirus; Severe acute respiratory syndrome virus; Hepatitis C virus; Yellow Fever virus; Dengue virus; West Nile virus; Rubella virus; Hepatitis E virus; Human Immunodeficiency virus (HIV); Influenza virus; Guanarito virus; Junin virus; Lassa virus; Machupo virus; Sabie virus; Crimean-Congo hemorrhagic fever virus; Ebola virus; Marburg virus; Measles virus; Mumps virus; Parainfluenza virus; Respiratory syncytial virus; Human metapneumovirus; Hendra virus; Nipah virus; Rabies virus; Hepatitis D; Rotavirus; Orbivirus; Coltivirus; Banna virus; Human Enterovirus; Hanta virus; West Nile virus; Middle East Respiratory Syndrome Corona Virus; Japanese encephalitis virus; Vesicular exanthernavirus; and Eastern equine encephalitis. In aspects, an EP comprises one or more Ags of encephalitis virus, Varicella-zoster virus; Human herpesvirus, type 8; BK virus; JC virus; Smallpox; polio virus, Human bocavirus; Parvovirus B19; Human astrovirus; Norwalk virus; coxsackievirus; poliovirus; rhinovirus; Severe acute respiratory syndrome virus; yellow fever virus; dengue virus; West Nile virus; Rubella virus; Hepatitis E virus; Guanarito virus; Junin virus; Lassa virus; Machupo virus; Sabievirus; Crimean-Congo hemorrhagic fever virus; Ebola virus; Marburg virus; Measles virus; Mumps virus; Parainfluenza virus; Respiratory syncytial virus; Human metapneumovirus; Hendra virus; Nipah virus; Rabies virus; Hepatitis D; Rotavirus; Orbivirus; Coltivirus; Hantavirus, Middle East Respiratory Coronavirus; Chikungunya virus, or Banna virus.

The virus can be a virus that is associated with any type of TR (e.g., dogs, pigs, or humans). Skilled readers understand that many viruses can infect different species. As such a virus identified as associated with a species (e.g., human influenza virus) means a virus that typically is predominately found or commonly associated with such species. Such identifications are used in the art to assist in the classification of viruses, but it will be understood that some viruses can infect multiple species or transmit/"jump" from a species to another species (as in the well-known case of avian flu being transmitted to humans). One aspect of the invention is the prevention of species-to-species transmission of viruses by therapeutic or preventive administration of viral Ag CEPESCs. For example, in one aspect the invention provides a method of reducing the likelihood or frequency of non-human species to human species transmission of virus comprising administration of CEPESCs to non-human TR(s), such as companion animals (e.g., dogs or cats), livestock, or both.

An EP can comprise a hepatitis antigen. A hepatitis antigen of an EP can be an antigen or immunogen from hepatitis A virus (HAV), hepatitis B virus (HBV), hepatitis C virus (HCV), hepatitis D virus (HDV), and/or hepatitis E virus (HEV). In some embodiments, the hepatitis antigen can be a heterologous nucleic acid molecule(s), such as a plasmid(s), which encodes one or more of the antigens from HAV, HBV, HCV, HDV, and HEV. The hepatitis antigen can be full-length or immunogenic fragments of full-length proteins. An HAV Ag can comprise a capsid protein, a HAV non-structural protein, a fragment thereof, a variant thereof, or a combination thereof. A HCV Ag can comprise a nucleocapsid protein (i.e., core protein), a HCV envelope protein (e.g., E1 and E2), a HCV non-structural protein (e.g., NS1, NS2, NS3, NS4a, NS4b, NS5a, and NS5b), a fragment thereof, a variant thereof, or a combination thereof. An HVD antigen can be a HDV delta antigen, fragment thereof, or variant thereof. A HEV Ag can be a HEV capsid protein, fragment thereof, or variant thereof. An HBV Ag can be a HBV core protein, a HBV surface protein, a HBV DNA polymerase, a HBV protein encoded by gene X, fragment thereof, variant thereof, or CT. An HBV Ag can be from any HBV genotype (e.g., A-H).

An HPV antigen can be any suitable HPV Ag. HPV Ags can be from, e.g., HPV types 16, 18, 31, 33, 35, 45, 52, and 58 which cause cervical cancer, rectal cancer, and/or other cancers. The HPV antigen can be from HPV types 6 and 11, which cause genital warts, and are known to be causes of head and neck cancer. HPV antigens can be the HPV E6 or E7 domains from each HPV type. For example, for HPV type 16 (HPV16), the HPV16 antigen can include the HPV16 E6 antigen, the HPV16 E7 antigen, fragments, variants, or combinations thereof. Similarly, the HPV antigen can be HPV 6 E6 and/or E7, HPV 11 E6 and/or E7, HPV 18 E6 and/or E7, HPV 31 E6 and/or E7, HPV 33 E6 and/or E7, HPV 52 E6 and/or E7, or HPV 58 E6 and/or E7, fragments, variants, or combinations thereof. In one embodiment an HPV antigen such as an E6 or E7 antigen disclosed herein is selected from an HPV 6 strain, and HPV 11 strain, HPV 16 strain, an HPV-18 strain, an HPV-31 strain, an HPV-35 strain, an HPV-39 strain, an HPV-45 strain, an HPV-51 strain an HPV-52 strain, an HPV-58 strain or an HPV-59 strain. In another embodiment, the HPV antigen is selected from a high-risk HPV strain. In another embodiment, the HPV strain is a mucosal HPV type. In another embodiment, HPV antigens can be selected from all HPV strains, including non-oncogenic HPVs such as type 6, 11, etc. that cause warts and dysplasias. In another embodiment, the HPV antigen is an HPV-31. In another embodiment, the HPV is an HPV-35. In another embodiment, the HPV is an HPV-39. In another embodiment, the HPV is an HPV-45. In another embodiment, the HPV is an HPV-51. In another embodiment, the HPV is an HPV-52. In another embodiment, the HPV is an HPV-58. In another embodiment, the HPV is a high-risk HPV type. In another embodiment, the HPV is a mucosal HPV type. In another embodiment, an HPV E6 antigen is utilized instead of or in addition to an E7 antigen in a composition or method disclosed herein for treating or ameliorating an HPV-mediated disease, disorder, or symptom.

An RSV antigen can be a human RSV fusion protein (also referred to herein as "RSV F", "RSV F protein" and "F protein"), or fragment or variant thereof. The human RSV fusion protein can be conserved between RSV subtypes A and B. The RSV antigen can be a RSV F protein, or fragment or variant thereof, from the RSV Long strain (GenBank AAX23994.1). The RSV antigen can be a RSV F protein from the RSV A2 strain (GenBank AAB59858.1), or a fragment or variant thereof. The RSV antigen can be a monomer, a dimer or trimer of the RSV F protein, or a fragment or variant thereof. The RSV antigen can be an optimized amino acid RSV F amino acid sequence, or fragment or variant thereof. An RSV antigen can also be human RSV attachment glycoprotein (also referred to herein as "RSV G", "RSV G protein" and "G protein"), or fragment or variant thereof. The human RSV G protein differs between RSV subtypes A and B. The antigen can be RSV G protein, or fragment or variant thereof, from the RSV Long strain (GenBank AAX23993). The RSV antigen can be RSV G protein from: the RSV subtype B isolate H5601, the RSV subtype B isolate H1068, the RSV subtype B isolate H5598, the RSV subtype B isolate H1123, or a fragment or variant thereof. The RSV antigen can be an optimized amino acid RSV G amino acid sequence, or fragment or variant thereof. An RSV antigen can be human RSV non-structural protein 1 ("NS1 protein"), or fragment or variant thereof. For example, the RSV antigen can be RSV NS1 protein, or fragment or variant thereof, from the RSV Long strain (GenBank AAX23987.1). The RSV antigen human can also be RSV non-structural protein 2 ("NS2 protein"), or fragment or variant thereof. For example, the RSV antigen can be RSV NS2 protein, or fragment or variant thereof, from the RSV Long strain (GenBank AAX23988.1). The RSV antigen can further be human RSV nucleocapsid ("N") protein, or fragment or variant thereof. For example, the RSV antigen can be RSV N protein, or fragment or variant thereof, from the RSV Long strain (GenBank AAX23989.1). The RSV antigen can be human RSV Phosphoprotein ("P") protein, or fragment or variant thereof. For example, the RSV antigen can be RSV P protein, or fragment or variant thereof, from the RSV Long strain (GenBank AAX23990.1). The RSV antigen also can be human RSV Matrix protein ("M") protein, or fragment or variant thereof. For example, the RSV antigen can be RSV M protein, or fragment or variant thereof, from the RSV Long strain (GenBank AAX23991.1). An RSV antigen can be human RSV small hydrophobic ("SH") protein, or fragment or variant thereof. For example, the RSV antigen can be RSV SH protein, or fragment or variant thereof, from the RSV Long strain (GenBank AAX23992.1). The RSV antigen can also be human RSV Matrix protein 2-1 ("M2-1") protein, or fragment or variant thereof. For example, the RSV antigen can be RSV M2-1 protein, or fragment or variant thereof, from the RSV Long strain (GenBank AAX23995.1). The RSV antigen can further be human RSV Matrix protein 2-2 ("M2-2") protein, or fragment or variant thereof. For example, the RSV antigen can be RSV M2-2 protein, or fragment or variant thereof, from the RSV Long strain (GenBank AAX23997.1). The RSV antigen human can be RSV Polymerase L ("L") protein, or fragment or variant thereof. For example, the RSV antigen can be RSV L protein, or fragment or variant thereof (e.g., GenBank AAX23996.1).

Viruses include DNA or RNA animal virus. As used herein, RNA viruses include, but are not limited to, virus families such as picornaviridae (e.g., polioviruses), reoviridae (e.g., rotaviruses), togaviridae (e.g., encephalitis viruses, yellow fever virus, rubella virus), orthomyxoviridae (e.g., influenza viruses), paramyxoviridae (e.g., respiratory syncytial virus (RSV), measles virus (MV), mumps virus (MuV), parainfluenza virus (PIV)), rhabdoviridae (e.g., rabies virus (RV)), coronaviridae, bunyaviridae, flaviviridae (e.g., hepatitis C virus (HCV)), filoviridae, arenaviridae, bunyaviridae, and retroviridae (e.g., human T-cell lymphotropic viruses (HTLV), human immunodeficiency viruses (HIV)). DNA viruses include, but are not limited to, virus families such as papovaviridae (e.g., papilloma viruses), adenoviridae (e.g., adenovirus), herpesviridae (e.g., herpes simplex viruses, e.g., HSV-1, HSV-2; varicella zoster virus (VZV); Epstein-Barr virus (EBV); cytomegalovirus (CMV); human herpesviruses, e.g., HHV-6 and HHV-7; Kaposi's sarcoma-associated herpesvirus (KSHV) and the like), and poxviridae (e.g., variola viruses). These and other viruses and viral proteins are included in the present invention and are described further in Knipe et al., Field's Virology, 4th ed., Lippincott Williams & Wilkins, 2001.

In AOTI, a viral DCA is an enveloped virus. Examples of enveloped viruses from which one or more Ags for inclusion in EPs can be obtained include Human Immunodeficiency Virus 1 (HIV-1), Human Immunodeficiency Virus 2 (HIV-2), Herpes 1 virus (HSV-1), Herpes 2 virus (HSV-2), Influenza Virus, Respiratory Syncytial Virus (RSV), Cytomegalovirus (CMV), Zika Virus (ZKV), Dengue Virus, West Nile Virus, Lassa Virus, Ebola Virus, Lloviu virus, Bundibugyo virus, Reston virus, Sudan virus, Tai Forest virus, Marburg virus, Ravn virus (RAW), Pneumovirus, Junin Virus, Rift Valley fever virus, La Crosse Virus, Porcine Reproductive And Respiratory Syndrome Virus, Poxvirus, Bovine Viral Diarrhea Norovirus, SARS Coronavirus, Chikunguya Virus, Hepatitis C Virus, Hepatitis B Virus, Schmallenberg virus, African swine fever virus, Eastern Equine Encephalitis Virus, Cowpox virus, Western Equine Encephalitis Virus, Nipah Virus, Omsk hemorrhagic fever Virus, Venezuelan Equine Encephalitis Virus, Human parainfluenza viruses, Japanese Encephalitis Virus, Tick Borne Encephalitis Virus, Russian spring-summer encephalitis (RSSE) virus, Yellow Fever Virus, Newcastle Virus, Parainfluenza virus type 5 (PIV5), Border Disease Virus (BDV) of sheep, Classical Swine Fever Virus (CSFV), Vesicular Stomatitis Virus (VSV) and HSV-2 acyclovir resistant (HSV-2 Acy R).

In AOTI, a viral antigen is specific to a virus selected from the group consisting of HIV, herpes, papillomavirus, ebola, picorna, enterovirus, measles virus, mumps virus, bird flu virus, rabies virus, VSV, dengue virus, hepatitis virus, rhinovirus, yellow fever virus, bunga virus, polyoma virus, coronavirus, rubella virus, echovirus, pox virus, varicella zoster, African swine fever virus, influenza virus and parainfluenza virus. In AOTI, a viral Ag is a fully or partially glycosylated surface glycoprotein, or fragment thereof, or a sequence of a typically glycosylated viral glycoprotein that is at least partially or fully deglycosylated. Examples of such Ags include influenza virus neuraminidase, influenza virus hemagglutinin, influenza virus M2 protein, human respiratory syncytial virus (RSV)-viral proteins, RSV F glycoprotein, RSV G glycoprotein, herpes simplex virus (HSV) viral proteins, herpes simplex virus glycoproteins gB, gC, gD, and gE, *Chlamydia* MOMP and PorB antigens, core protein, matrix protein or other proteins of Dengue virus, measles virus hemagglutinin, herpes simplex virus type 2 glycoprotein gB, poliovirus I VP1, envelope glycoproteins of HIV 1, hepatitis B surface antigen, diptheria toxin, *Streptococcus* 24M epitope, Gonococcal pilin, pseudorabies virus g50 (gpD), pseudorabies virus II (gpB), pseudorabies virus III (gpC), pseudorabies virus glycoprotein H, pseudorabies virus glycoprotein E, transmissible gastroenteritis glycoprotein 195, transmissible gastroenteritis matrix protein, swine rotavirus glycoprotein 38, swine parvovirus capsid protein, Serpulinahydodysenteriae protective antigen, bovine viral diarrhea glycoprotein 55, Newcastle disease virus hemagglutinin-neuraminidase, swine flu hemagglutinin, swine flu neuraminidase, infectious bovine rhinotracheitis virus glycoprotein E, glycoprotein G, infectious laryngotracheitis virus, infectious laryngotracheitis virus glycoprotein G or glycoprotein I, hepatitis B virus core protein and hepatitis B virus surface antigen or a fragment or derivative thereof, antigen of equine influenza virus or equine herpes virus, including equine influenza virus type A/Alaska 91 neuraminidase, equine influenza virus typeA/Miami 63 neuraminidase, equine influenza virus type A/Kentucky 81 neuraminidase equine herpes virus type 1 glycoprotein B, and equine herpes virus type 1 glycoprotein D, antigen of bovine respiratory syncytial virus or bovine parainfluenza virus, bovine respiratory syncytial virus attachment protein (BRSV G), bovine respiratory syncytial virus fusion protein (BRSV F), bovine respiratory syncytial virus nucleocapsid protein (BRSVN), bovine parainfluenza virus type 3 fusion protein, bovine parainfluenza virus type 3 hemagglutinin neuraminidase, bovine viral diarrhea virus glycoprotein 48 and glycoprotein 53, glycoprotein E of Dengue virus and glycoprotein E1 or E2 of human hepatitis C virus. Additional glycosylated viral Ags include glycoproteins of La Crosse virus, neonatal calf diarrhea virus, Venezuelan equine encephalomyelitis virus, punta toro virus, murine leukemia virus, and mouse mammary tumor virus, foot and mouth disease virus, hog cholera virus, swine influenza virus, ASFV, *Mycoplasma* liyopneutiioniae, and infectious bovine rhinotracheitis virus.

In aspects, an EP comprises one or more HIV Ags. HIV Ags can be from any subtype of HIV (e.g., A-D). Exemplary HIV Ags include MPol, Env A, Env B, Env C, Env D, B Nef-Rev, Gag, or any combination thereof.

In AOTI, an EP comprises a Lymphocytic Choriomeningitis Virus (LCMV) Antigen. An LCMV Ag can be an antigen from LCMV Armstrong. The LCMV antigen can be an antigen from LCMV clone 13. The LCMV antigen can be a nucleoprotein (NP) from LCMV, a glycoprotein (GP; e.g., GP-1, GP-2, and GP-C) from LCMV, a L protein from LCMV, a Z polypeptide from LCMV, a fragment thereof, a variant thereof, or a combination thereof.

A non-limiting list of infectious diseases that compositions of the invention can be used to induce, promote, or enhance immune responses in connection with include hepatitis A, B, C, D or E, herpes, herpes zoster (chicken pox), German measles (rubella virus), yellow fever, dengue fever etc. (flavi viruses), flu (influenza viruses), haemorrhagic infectious diseases (Marburg or Ebola viruses), AIDS (HIV) and other HIV-associated diseases, respiratory infections such as adenovirus infection, aspergillosis infections, avian (H5N1) influenza, influenza, RSV infections, severe acute respiratory syndrome (SARS), sinusitis, Legionellosis, viral skin diseases such as B19 parvovirus infections, warts, genital herpes, orofacial herpes, shingles, inner ear infections, fetal cytomegalovirus syndrome, bioterrorism and potential epidemic diseases such as Ebola haemorrhagic fever, Lassa fever, Marburg haemorrhagic fever, acquired immune deficiency syndrome, African swine fever, anthrax, bubonic plague, cervical cancer, chicken pox, Coxsackie, dengue fever, diphtheria, Ebola virus, echovirus, encephalitis, gastroenteritis, hepatitis, herpes, human immunodeficiency disease (HIV-1 or HIV-2), influenza, lower respiratory tract infection, Lyme disease, Marburg, measles, monkeypox, mumps, Norwalk virus infection, papillomavirus, parainfluenza, parvovirus, picorna virus infection, measles, polio, rotavirus infection, rubella, shingles, smallpox, swine flu, and yellow fever. Accordingly, EPs can comprise one or more Ags against the DCAs that are the causative agents of such diseases.

To still illustrate aspects wherein EPs comprise one or more viral Ags, exemplary aspects including constructs relevant specific types of viruses are provided in the following seven sections.

1) PCV

In AOTI, constructs comprise AgES(s) encoding Ag(s) of/against porcine circovirus (PCV). EP(s) can comprise any suitable number of PCV Ag(s) against any suitable type of PCV (e.g., PCV-1, PCV-2, or PCV-3, any one or more subtypes thereof, or combinations of any thereof).

In AOTI, OSMGAOA PCV Ag(s) of CEPs are AW PTPS(s), such as one or more polyUb sequences. In aspects, NS(s) comprising PCV AgESs are mostly, generally, or only contained in NAV(s). In AOTI, NAV(s) are plasmids. In aspects, NSs comprise EEI(s) associated with the PCV AgES, gDP(s), or both.

In aspects, OSMGAOA PCV Ag(s) are delivered in gDAgFP(s). In aspects, the gD portion of OSMGAOA gDAgFP(s) of such CEPESCs exhibit preferred/selective affinity for gD receptor(s) (gDR(s)) over HVEM (e.g., nectin-1, nectin-2, or homologs). In AOTI, OSMGAOA gDP(s) in such CEPs exhibit significantly reduced HVEM binding WRT to HSV-1 gD, do not exhibit significant binding of HVEM, or both. In aspects, OSMGAOA of gDAgFP(s) of such CEPs lack a functioning gD TMD. In aspects, gDAgFP(s) or other EP(s) comprise EP(s) comprising 2+, 3+, or ≥4 PCV Ag(s), wherein the PE optionally includes linker(s) (e.g., MSL(s), FL(s), or MSFL(s)), cleavage sites (e.g., SCS(s), such as 2A sites), or CT. In aspects, EP(s) include TS(s), e.g., ITS(s), such as an ERTPS, an exosome TS, PTPS(s), or CT. In aspects, OSMGAOA PCV Ag AgES(s) are contained in one or more viral vectors. In AOTI, the viral vector is a vector comprising primarily or generally comprising non-pathogenic PCV1 genes but containing anti-PCV2 Ags, anti-PCV3 Ags, or CT.

In AOTI, PCV Ag(s) are chimeras/hybrids comprising Ags of 2+ PCVs, composed of AARSs of 2 PCVs, or CT (examples of hybrid PCV Ags are exemplified in, e.g., Opriessnig T et al, 2014, CEH). In aspects, PCV Ag(s) comprise hybrid Ag(s) (e.g., PCV-2 Ag(s) and PCV-3 Ag(s)). Other hybrid Ags can be generated by, e.g., combining effective portions of bat circovirus genomes known to be related to PCV with PCV2 or PCV3 AgESs.

In aspects, OSMGAOA PCV Ag(s) of a CEP are AgV(s). In AOTI, AgV(s) comprise editope(s). In AOTI, PCV AgV(s) of CEPs ACA based on comprising GSRV(s). In aspects, GSRV(s) in PCV Ag(s), and optionally also in other EP(s), result in the CEP being AW a DOS reduction in humoral antigenicity; enhanced efficacy in promoting, inducing, or enhancing one or more aspects of IR(s); and reduced likelihood of CSAE(s), e.g., cytokine storm syndrome, Vaccine-Associated Enhanced Respiratory Disease ("VAERD"), or CT.

In AOTI, NSs of such CEPESCs are contained in plasmids that are at least primarily or generally associated with TFA(s), such as a CaPNP(s). In methods, the delivery of such CEPESCs to TR(s) comprises, PC, GCO, or CO mucosal administration of CEPESC(s) to TR(s) (e.g., pigs, humans, or both).

In aspects, CEPs comprise PCV1 Ag(s). In aspects, CEPs comprise PCV2 Ag(s) & PCV3 Ag(s); PCV2 Ag(s) & PCV1 Ag(s); PCV1 Ag(s) & PCV3 Ag(s); or a combination of PCV1, PCV2, and PCV3 Ags. In AOTI, such Ag(s) comprise AgV(s), e.g., GSRAgV(s), e.g., a PCV1 ORF1 GSRAgV, a PCV1 ORF4 GSRAgV, a PCV1 ORF2 GSRAgV, or CT.

In aspects, PCV Ag CEPs comprise non-gD PCM(s), such as PCI(s). In AOTI, a PCV Ag EP will comprise a PD-L1 antagonist CI AARS or PPT. In AOTI, a PCV Ag CEP comprises ICSTAPs, e.g., EAT-2 or SAP PPTs.

In aspects, administration of a PCV AgES CEPESC to TR(s) is repeated two or more times. In aspects, administration of a PCV AgES CEPESC is combined with the administration of an anti-PCV vaccine in a prophylactic method. In aspects, the administration of a PCV AgES CESESC is combined with one or more anti-viral therapies or therapies for the symptoms of PCV.

Administration of the PCV AgES CEPESCs induces DOS IR(s) against PCV(s). In aspects, such IR(s) comprise a significant anti-PCV T cell IR, a significant anti-PCV Ag B cell IR, or both. In aspects, a PCV Ag CEP will comprise MHCIE(s), MHCIIE(s), BCE(s), or a combination of 2 or 3 thereof.

In aspects, delivery of PCV AgES CEPESC(s) induces IR(s) against at least two subtypes of PCV (e.g., a combination of 2 or 3 of PCV2a, PCV2b, and PCV2d), two or more types of PCV (e.g., PCV2 and PCV3), or both. In aspects, the PCV Ag EPESC will elicit effective anti-PCV B and T cell immunity and durable memory responses that will recognize and destroy field-relevant PCV strains upon primary infection; clear PCV infected cells from chronically infected pigs harboring endogenous PCV (reservoir) when the virus emerges from latency; or both, in detectable or significant levels.

In aspects, the administration of an effective amount of a PCV CEPESC one or more times to TR(s) (e.g., a pig or population of pigs) results in DOS improvement in aspect(s) of the prevention, treatment, or both of one or more PCV-associated conditions, such as postweaning multisystemic wasting syndrome (PMWS), PCV2-systemic disease (PCV2-SD), or other porcine circovirus diseases (PCVDs) or an improvement in one or more clinical symptoms or other aspects thereof. For example, administration of a PCV Ag EPESC can result in a detectable or significant improvement in lymphoid depletion, lymphoid inflammation, positive IHC for PCV2 antigen of lymphoid tissue, viremia, nasal shedding, pyrexia, reduced average daily weight gain, lung inflammation, positive IHC for PCV2 antigen of lung tissue, or mortality.

In aspects, an anti-PCV AgES CEPESC will exhibit DOS PCV Ag-specific IR(s) at about 7 days post treatment (pt) or post challenge inoculation (pi); also or alternatively at about 14 days pt or pi; also or alternatively at about 28 days pt or pi; also or alternatively at about 45 days pt or pi; also or alternatively at about 60 days pt or pi; also or alternatively at about 90 days pt or pi; also or alternatively about 6 months pt or pi; also or alternatively about 12 months pt or pi; also or alternatively about 18 months pt or pi; also or alternatively about 2 years pt or pi; or also or alternatively about 3 years pt or pi. In aspects, an anti-PCV EP protected or treated pig will exhibit a reduced PCV qPCR measurement after any such period after one, two, or more PCV challenges. In aspects, an anti-PCV EP will result in a detectably or significantly reduced amount of total PCV-associated lymphoid lesions in infected or challenged pigs. In aspects, an anti-PCV EP will result in a detectably or significantly reduced number of lesions that are considered severe lesions according to standard classification practice. In aspects, an anti-PCV Ag EP will result in one or more improvements in PCV health-related indicators in a CDCD pig model as compared to similar untreated pigs under similar conditions, Circovac®-treated pigs under similar conditions or both. In aspects, an anti-PCV EP treated or protected pig will exhibit a reduction in PCV as determined by sera testing, fecal/rectal swabbing, or both, in any such period, with analysis performed by viral counting methods, ELISA, and the like. Measurement of indicators of PCV infection are described in, e.g., Palya V. Virol J. 2018; 15(1):185. In aspects, delivery of an EA of anti-PCV EP as a protective method, therapeutic method or both, one or more times, results in a DOS reduction in PCV-associated disease (PCVAD) in a population of swine or a detectable or significant reduction of one or more aspects/symptoms of PCVAD such as a reduction of wasting in PCV-2 associated pigs. In aspects, an anti-PCV EP also or alternatively results in cross-protective immune responses for two, three, or more types of PCV.

In aspects, treatment or prophylaxis of PCV infection by administering an effective amount of PCV AgES CEPESC(s) results in DOS improvement in comparison to animals of a non-treated control group of the same species/class in a vaccine efficacy parameter selected from the group consisting of a reduction in loss of weight or reduced weight gain, a shorter duration of viremia, an earlier end to viremia, a lower virus load, in delay of onset of viremia, in a reduced viral persistence, in a reduction of the overall viral load and/or a reduction of viral excretion, or combinations of any or all thereof. In aspects, administration of the PCV Ag EPESC also or alternatively results in detectably or significantly reducing lymphadenopalhy, lymphoid depletion and/or multinucleated/giant histiocytes in animals infected with PCV or subsequently challenged with PCV. In aspects, administration of the PCV Ag EPESC results in detectably or significantly reducing (1) interstitial pneumonia with interlobular edema, (2) cutaneous pallor or icterus, (3) mottled atrophic livers, (4) gastric ulcers. (5) nephritis (6) reproductive disorders, e.g. abortion, stillbirths, mummies, etc, (7) Pia like lesions, normally known to be associated with Lawsonia intracellularis infections (Ileitis). (8) lymphadenopathy, (9) lymphoid depletion and/or (10) multinucleated/giant histiocytes (1 1) Porcine Dermatitis and Nephropathy Syndrome (PDNS), (12) PCVAD associated mortality, (13) PCVAD associated weight loss, (14). reduced growth variability (15), reduced frequency of 'runts' (16), reduced co-infections with Porcine Reproductive and Respiratory Disease Complex (PRRSV), or a combination of any or all thereof in a PCV infected or subsequently challenged pig (or both). In aspects, administration of a PCV AgES CEPESC results in DOS improvement in one or more economic/growth parameters in PCV infected or PCV challenged pigs such as time to slaughter, carcass weight, improvement in average weight gain, lean meat ratio, or a combination of any or all thereof. In aspects, delivery of the PCV Ag EPESC reduces the overall circovirus load including a later onset, a shorter duration, an earlier end of viremia, and a reduced viral load and its immunosuppressive impact in young animals, in particular in those having anti-PCV2 antibodies at the day of vaccination, thereby resulting in a higher level of general disease resistance and a reduced incidence of PCV2 associated diseases (e.g., PRRSV, swine influenza virus (SIV), and *Mycoplasma* hyopneumoniae, or a combination of any or all thereof) and symptoms. In aspects, administration of a PCV Ag EPESC also or alternatively results in a detectable or significant reduction in wasting, severe wasting, enlarged lymph nodes, respiratory illness, jaundice, or combination or any or all thereof.

In aspects, PCV AgES CEPESC(s) are administered in an effective amount to a piglet (an un-weaned pig or a pig that is about 2 months in age or less). In AOTI, an effective amount of a PCV Ag EPESC is administered to a population of pigs that still exhibits a significant amount of material anti-PCV2 antibodies. In aspects, a PCV Ag EPESC is administered to a population of swine that has an average age of less than about 12 weeks in age, less than about 10 weeks in age, less than about 8 weeks in age, less than about 7 weeks in age, less than about 6 weeks in age, less than about 5 weeks in age, or less than about 4 weeks in age (e.g., 1-10 weeks, 2-10 weeks, 3-9 weeks, 2-8 weeks, 1-8 weeks, 2-6 weeks, 1-7 weeks, 1-6 weeks, 1-4 weeks, or 2-4 weeks in age). In aspects, the PCV Ag EPESC is delivered to pigs of between about 1-30 days of age, such as about 2-30, about 3-30, about 1-21, about 3-21, about 2-24, or about 2-22 days of age. In aspects, all pigs of a population treated with a PCV Ag EPESC are within such an indicated range or below such an indicated maximum age (e.g., 6 weeks, 4 weeks, or 3 weeks of age).

In aspects, an at least as effective immune response, detectably or significant better immune response, or detectably or significantly improved clinical outcome in any of the above-described aspects is achieved from the delivery of an effective amount of a PCV Ag EPESC to pigs with a lower incidence of adverse events (e.g., a lower incidence of cytokine storm events), a lower number of required or required average administrations of medicament, or both, than with a current on-market anti-PCV vaccine, anti-PCV immunogen therapy, or any such therapy or vaccine described in the prior art.

In aspects, compositions comprising EPs expressing one or more PCV CRAs are provided. In AOTI, methods of identifying candidate PCV CRAs are provided, as exemplified in the Examples. Briefly, such methods comprise identification of putative antigens by any suitable method (e.g., ELI or from cells obtained from infected and recovered pigs or pig cells). Putative PCV Ag constructs can be developed from such materials identified from such methods (and which can be optionally combined with known PCV Ags), leading to preparation of test CEPESCs comprising corresponding AgESs, typically comprising ES(s) for gDP(s) (e.g., gDAgFP(s) comprising putative PCV Ag(s)). Such CEPESCs can then be tested in either clinical studies to identify CRAs. CRAs meeting pre-determined standards can be analyzed and sequenced to identify PCV epitopes and develop AgV(s), such as editope(s)/GSRAgV(s).

In aspects, the PCV Ag EPESC comprises, PC, or only comprises NAM(s) that are NAV(s). In aspects, NAV(s) are AW TFA(s) that DOS enhance IR(s) in TR(s). In aspects, such TFA(s) comprise CaPNP(s).

The PCV treatment and prophylaxis/vaccination methods also represent 1 facet of the AOTI directed to treatment of leaky vaccine-associated disorders. E.g., although PCV2 vaccines can reduce clinical signs of PCVAD, such on-market vaccines are "leaky" and do not provide sterilizing immunity. As such, pigs vaccinated with currently available vaccines can still become infected with PCV2 and spread the virus. Moreover, such leaky vaccines at least typically fail to confer protection from repeated PCV exposure, coinfection, and mutations that foster the spread of virus within herds and increase the PCV reservoir in a population. Use of PCV Ag EPESCs can surprisingly overcome SMGAOA aspects of such leaky vaccine associated challenges, such as detectably, generally completely, substantially completely, or completely eliminating transmission of PCV from chronically infected animals; prevent infection in a significant fraction of a herd, independent of the number of relevant PCV exposures over the lifetimes of individual members; or both.

(b) PCV-2 and PCV2-Related Ag EP Aspects

In AOTI, CEPs comprise PCV2 Ag(s). In AOTI, CEPs comprise PCV2a Ag(s), PCV2b Ag(s), PCV2c Ag(s), PCV2d Ag(s), PCV2d-mPVCC2b Ag(s), or PCV2e Ag(s). Classification of PCV is still developing and may change in the future (SFE Franzo G, Virol J. 2015; 12:131), but the efficacy of CEPs against PCVs is expected to apply regardless of such changes in classification of PCV species/strains. The biology of many PCV strains is KITA and ATAOTI (SFE Chen F et al. J Virol. 2012; 86(22):12457-12458, with respect to a strain of PCV2d; Cheung A K. Virology. 2003; 305(1):168-180, describing, i.a., PCV2 strain 688, which has a 236 AAR ORF2 (see also UniProt Access No. 056129); and Hamel, A. L. et al. J. Virol. 72 (6), 5262-5267 (1998) (providing the complete genome of a PCV2 virus) (see also Trible B R, Virus Res. 2012; 164(1-2):68-77 and Karuppannan A K. Viruses. 2017; 9(5):99. Published 2017 May 6). Numerous additional PCV strains have been sequenced and characterized in GenBank (SFE Access Nos. JX535296, JX519293, MG833033, and JQ653449 (with respect to PCV2d isolates, for example). In aspects, CEPs comprise Ag(s) of/against a PCV "mutant" strain, such as the US isolated mPCV2 (Opriessnig T et al. J Gen Virol. 2014; 95(Pt 11):2495-2503) or the enhanced virulence PCV2b-234-K variant (K addition in ORF2) strain (SFE Guo L et al. PLoS One. 2012; 7(7):e41463).

In AOTI, CEPs comprise one of a PCV-2 ORF1, ORF2, ORF3, or ORF4 or a fragment of any thereof (e.g., a fragment comprising S, M, or GA thereof). In aspects, CEPs comprise PCV2d Ag(s) or PCV2b Ag(s). In AOTI, CEPs comprise PCV Ags against 2+ PCV2 subtypes. In AOTI, CEPs comprises a PCV2 ORF3 EP (e.g., EL ORF3, GA of ORF3, most of ORF3, or some of ORF3). In aspects, CEPs comprise a PCV Rep, Rep', or Cap protein, or CT. In AOTI, PCV Ag CEPs comprise PCV2 Ag(s) from at least two PCV2 ORFs, such as any 3 or 4 PCV2 ORFs. In AOTI, PCV Ag CEPs comprises PCV2 ORF2 Ag(s) and non-ORF2 PCV Ag(s), e.g., ORF1 Ag(s), ORF3 Ag(s), ORF4 Ag(s), or CT, such as an ORF3 Ag and ORF1 Ag or ORF4 Ag. In AOTI, PCV2 Ag CEPs comprise ORF2 Ag(s) & ORF3 Ag(s). In AOTI, CEPs comprise PCV2a Ag(s) & PCV2b Ag(s).

In AOTI, a PCV2 Ag CEP comprises PCV2 BCE(s), e.g., BCE(s) AW anti-PCV2 neutralizing Abs. In AOTI, any such PCV-2 Abs preferably bind endogenous PCV over EPs or do not significantly bind EPs or do not DOS impair MGAOA of the IR(s) induced by EP(s). BCEs of PCV are KITA and additional examples of such BCEs can be identified using methods DEH. Examples of such epitopes include PCV2 capsid AAs 65-87, 113-139, 169-183, and 193-207.

PCV2 Ags and related compositions and methods that can be combined with aspects of this disclosure are known in the art. For example, WO03/049703 describes production of a live chimeric vaccine is described, comprising a PCV-I backbone in which an immunogenic gene of a pathogenic PCV2 strains replaces a gene of the PCV-I backbone. WO99/18214 describes several PCV2 strains. An ORF-2 based subunit vaccine has been reported in WO2006/072065 and in WO2007/028823. A PCV2b ORF2 protein is disclosed in WO2019025519. Additional PCV2 antigens are provided in WO2006/072065 (e.g., SEQ ID NOs: 11, 10, 9, or 5 therein). Nucleotide sequences for such Ags also are KITA (e.g., SEQ ID NOs: 3 and 4 therein). Additional PCV2 Ags, sequences, and methods are described in, e.g., US20180236057; US20150056248; US20170232094; US20160206727; WO2008076915; U.S. Ser. No. 10/131, 696 and U.S. Pat. No. 9,932,372. PCV2 T cell epitopes are described in, e.g., Stevenson L S et al. Viral Immunol. 2007; 20(3):389-398 and Wyatt, C., 2009, Mapping T cell epitopes in PCV2 capsid protein, National Pork Board Report, available at pork.org/research/mapping-t-cell-epitopes-in-pcv2-capsid-protein/. PCV Ags, epitopes, and related compositions are disclosed in, e.g., WO2017/187277; UniProt Access Number F5A4Z4; CN103536912; Mahé D et al. J Gen Virol. 2000; 81(Pt 7):1815-1824; and Bandrick M et al. Vet Immunol Immunopathol. 2020; 223:110034. PCV Ag EPs can comprise any PCV Ag(s) or epitope(s) described in these references or that are otherwise KITA. Methods for treating PCV infections and preventing PCV infections can employ any suitable methods, compositions, or standards therein.

In AOTI, CEPs comprise PCV2 AgV(s), e.g., PCV2 editope(s). An example of such an AgV is a variant comprising a modification at position 143, 145, or both, typically position 143, resulting in deletion of a potential NLGS.

In AOTI, PCV2 AgV(s) exhibit enhanced antigenicity as compared to WTC(s). An example of such an editope is the chimeric PCV2 ORF2 protein in the chimeric virus PCV2-3cl, generated through application of gene shuffling methods (see WO2017187277), or a related antigenic virus developed by application of such gene shuffling techniques (e.g., a PCV2 capsid polypeptide selected from the PCV capsid polypeptides designated as 3cl.14 (SEQ ID NO: 8 of WO2017187277), 3cl. 13 (SEQ ID NO: 4 of W2017187277), 3cl.4_2 (SEQ ID NO: 2 of WO2017187277), and 3cl. 12_2 (SEQ ID NO: 6 WO2017187277).

In aspects, CEPs comprising PCV2 Ag(s) are CB the lack of any PCV2 decoy epitopes or the removal of any PCV2 decoy epitopes (through substitution or deletion). PCV2 decoy epitopes are known and DEH.

In AOTI, CEPs comprise Ags from/related to PCV2 ORF9. In AOTI, CEPs comprise a PCV2 Ag comprising an AARs RVRHRSIOI to SEQ ID NO:654.

In aspects, an EP will comprise one or more Ags from or that are at least related to a PCV2 ORF1 sequence. In AOTI, an EP will comprise a PCV2 Ag comprising a sequence that RVRHRSIOI to SEQ ID NO:654. In AOTI, CEPs comprise a GSRAgV(s) of an ORF1 sequence, e.g., 1+ of SEQ ID NOs:655-657

In aspects, CEPs comprise Ag(s) of related to a PCV2 ORF3 sequence. In AOTI, CEPs comprise PCV2 Ag(s) RVRHRSIOI to SEQ ID NO:658.

In aspects, CEPs comprise Ag(s) from or related to a PCV2 ORF4 PPT. In AOTI, CEPs comprise PCV2 Ag(s) RVRHRSIOI to SEQ ID NO:659. In aspects, CEPs comprise GSRVs of ORF4 PPTs (e.g., SEQ ID NO:660) or FFs/FVs.

In aspects, CEPs comprise Ag(s) from or related to a PCV2 ORF8 PPT. In AOTI, CEPs comprise PCV2 Ag(s) are RVRHRSIOI to SEQ ID NO:661.

In aspects, CEPs comprise Ag(s) from or related to a PCV2 ORF11 PPT. In AOTI, CEPs comprise PCV2 Ag(s) RVRHRSIOI to SEQ ID NO:662.

In aspects, CEPs comprise Ags from or related to a PCV2 ORF5 PPT. In AOTI, CEPs comprise a PCV2 Ag RVRHRSIOI to SEQ ID NO:663.

In aspects, CEPs comprise Ag(s) from or related to PCV2 ORF10 PPTs. In AOTI, comprise PCV2 Ag(s) RVRHRSIOI to SEQ ID NO:664.

In aspects, CEPs comprise Ag(s) from or related to PCV2 ORF7 PPTs. In AOTI, CEPs comprise PCV2 Ag(s) RVRHRSIOI to SEQ ID NO:665.

In aspects, CEPs comprise Ag(s) from or related to a PCV2 ORF2 PPT. In AOTI, CEPs comprise PCV2 Ag(s) RVRHRSIOI to SEQ ID NO:24. In aspects, CEPs comprise PCV2 ORF2-related GSRVAg(s) (e.g., SEQ ID NO:25 or SEQ ID NO:666). In AOTI, CEPs include PCV2 ORF2 FVs per the formula MTYPRRRX$_8$RR-RRHRPRSHLGX$_{21}$ILRRRPWLVHPRHRYRWRRKN-GIFNX$_{47}$RLSRX$_{52}$X$_{53}$X$_{54}$YTX$_{57}$X$_{58}$X$_{59}$X$_{60}$X$_{61}$VX$_{63}$T-PSWAVDMMRFX$_{75}$X$_{76}$X$_{77}$X$_{78}$FVPPGGGX$_{86}$NX$_{88}$X$_{89}$-X$_{90}$IPFEYYRIRKVKVEFX$_{106}$X$_{107}$X$_{108}$SPITQGDRGV-GSTAVILX$_{126}$DNFVTKATALTYDP YVX$_{143}$YSSRHTIPQPFSYHSRYFTPKPVLDSTIDYF-QPNNKRNLWLRLQTX$_{190}$X$_{191}$NVDH VGLGX$_{200}$AFX$_{203}$NSX$_{206}$X$_{207}$X$_{208}$QX$_{210}$YNX$_{213}$R-X$_{215}$TMYVQFREFNLKDPPLX$_{232}$X$_{233}$X$_{234}$X$_{235}$ (SEQ ID NO:668), wherein X8 is Y or F, typically Y; X21 is Q, L, or H, typically Q; X47 is T, A, or S, typically T/A; X52 is T or S; X53 is F or I, typically F; X54 is G or V; X57 is V or I, typically V; X58 is K or N; X59 is A or R; X60 is T or S; X61 is T or Q; X63 is R, S, or T; X75 is D, N, or K, typically D/N; X76 is I or F, typically I; X77 is D or N; X78 is D or Q; X86 is T or S; X88 is K or P; X89 is I, R, or L; X90 is S or T; X106 is W of R; X107 is P or A; X108 is C or R; X126 is T or S, usually T; X143 is D or N, usually D; X190 is S, A, or T, typically S or T; X191 is R, G, or K, typically R or G; X200 is T or H; X203 is E or Q; X206 is I, T, or K, typically T; X207 is Y or N; X208 is D or A; X210 is D, E, or A, typically D or A; X213 is I or V; X215 is I or V, typically V; X232 is K or N, typically K; X234 is P, K, or is absent, typically P or K; & X235 is K or is absent.

In aspects, PCV2 AgES CEPs encode PCV2 Ag mimotope(s). Examples of PCV2 Ag mimotopes and related PMCs are in, e.g., Hung L C et al. BMC Immunol. 2017; 18(1):25. doi:10.1186/s12865-017-0211-2 and WO2006/072065. Other mimotope methods DEH are adaptable to such AOTI.

In aspects, PCV2 Ag EPs can also or alternatively comprise one or more hybrid Ags comprising one or more non-PCV2 Ags. Such methods can be relevant given the prevalence of PCV2 co-infections, such as SIV & PRRSV. As such, in aspects, PCV Ag EPs additional comprise Ag(s) of/against any such potential PCV co-infection agents. Examples of hybrid PCV2 Ags, e.g., are described in, e.g., Pineyro P E et al. Virus Res. 2015; 210:154-164. doi: 10.1016/j.virusres.2015.07.027 and Li X et al. Appl Microbiol Biotechnol. 2018; 102(24):10541-10550. doi:10.1007/s00253-018-9361-2. Such Ags and targets can be employed in PCV2 Ag CEPs.

In aspects, a PCV2 Ag EP will comprise one or more polyepitope fusion proteins. In aspects, one, some, generally all, or all of such polypeptide sequences will be contained in gDAgFPs. In aspects, at least one polyepitope sequence will comprise one or more linkers (e.g., mid-sized or flexible linkers), one or more cleavage sites, one or more PTPSs (e.g., one or more polyUb sequences) or other ITSs, or a combination of any or all thereof. In aspects, at least one Ag of a polyepitope sequence will comprise an Ag variant, such as a deglycosylation variant. In aspects, PE(s) will comprise Ag(s) from at least two, ≥3, ≥4, ≥5, ≥6, or at least seven PCV2 ORFs (e.g., 2-8 PCV2 ORFs, 2-7 PCV2 ORFs, 2-5 PCV2 ORFs, or 2-3 PCV2 ORFs). In aspects, a polyepitope sequence also or alternatively will comprise at least two, at least three, at least four, at least five, at least six, at least seven or more discrete Ag sequences (e.g., 2-12, 2-10, 2-8, 2-7, 3-15, 3-12, 3-9, or 3-7 discrete Ag sequences), most, generally all, or all of which are PCV2 Ag sequences (including variants). An example of such a construct is a construct according to the formula gD1-optional linker-ORF9Ag-linker-ORF4Ag-linker-ORF8Ag-linker-ORF11Ag-linker-ORF10Ag-linker-ORF6Ag-linker-ORF7Ag-optional linker-gD2 (exemplary gD1 and gD2 sequences are described elsewhere herein).

Several vaccines against PCV2 are commercially available. Porcilis® PCV (available from MSD Animal Health, Boxmeer, The Netherlands) is a vaccine for protection of pigs against porcine circo virus type 2, for use in pigs from three weeks and older. When given as a two-shot (two dose) vaccine, the duration of immunity (DOI) is 22 weeks. CircoFlex® (available from Boehringer Ingelheim, Ingelheim) is a vaccine for protection of pigs against porcine circo virus type 2, for use in pigs from two weeks and older. It is registered as a one-shot (one dose) vaccine only. Circovac® (available from Merial, Lyon, France) is a vaccine for protection of pigs against porcine circo virus type 2, for use in pigs three weeks and older. Suvaxyn® PCV (available from Zoetis, Capelle a/d IJssel, The Netherlands) is a vaccine for protection of pigs against PCV2, for use in pigs 3 weeks and older. Other PCV2 vaccines are described in WO2007/028823, WO 2007/094893, and WO2008/076915. All on-market recombinant vaccines target the immunogenic capsid protein of the virus encoded by ORF2, while the conventional, inactivated vaccines are whole virus preparations (Beach and Meng, 2012). Such vaccines can be combined with a PCV AgES CEPESC or can be administered in AW PCV AgES CEPESC(s).

In aspects, an effective amount of a PCV2 Ag EPESC will exhibit a detectably or significantly improved immune response in one or more aspects as compared to a recommended dose (e.g., 0.5 ml in piglets or 2 ml in mature pigs) of Circovac®, an FDA approved PCV treatment or over any of the other above-described approved treatment/vaccines administered according to their recommended application regimens. In AOTI, EPs exhibit a better immune response in one or more respects against more types of PCV2 viruses. In aspects, EPs also or alternatively exhibit an immune response that is detectably better or significantly better than Circovac® against PCV2A viruses. In aspects, the improved immune response comprises a significantly better memory immune response than Circovac® or any other 1+, 2+, or all of the other above-described commercial on-market vaccines. In aspects, the improved immune response comprises a significantly better T cell response, a significantly better innate trained immune response, or both, as compared to any one, some, or all of such on-market vaccines. In aspects, an EP will result in significantly reduced shedding, significantly reduced PCV-associated viremia, or both, as compared to any one, some, or all of such vaccines, and in aspects administration of an PCV2 Ag EPESC will result in significantly improved shedding reduction, significantly reduced PCV-associated viremia, or both, as compared to Circovac® or any other OSMOA of the on-market PCV2 vaccines. In aspects, an EP will exhibit any of the above-described improved responses as compared to Circovac® or any other one, some, or all of the on-market PCV2 vaccines/treatments in PCV2d pigs. Clinical experience with Circovac® in PCV2a and PCV2d pigs ATAOTI is KITA (SFE Opriessnig T et al. Vaccine. 2017; 35(2):248-254).

In aspects, a PCV Ag EP will comprise a PPT comprising an AARS that is at least about 70%, 80%, 85%, 90%, 95%, 97%, or 99% identical to an at least 8 AA AARS, an at least 12 AA AARS, an at least 15 AA AARS, ≥20 AA AARS, ≥50

AA AARS, or ≥100 AA AARS in, e.g., SEQ ID NO: 24 and that induces significant IR(s) against PCV(s) when expressed in TR(s). In AOTI, an EP comprises SEQ ID NO: 25. In AOTI, an EP comprises SEQ ID NO: 24.

(c) PCV-3 and PCV3-Ag EP Aspects

In aspects, an EP will also or alternatively comprise one or more PCV3 Ags. PCV3 has recently been identified as a virus that is distinct from and distantly related to other PCVs and causes porcine dermatitis and nephropathy syndrome (PDNS) and reproductive failure in non-PCV2-infected pigs. See Palinski R et al. *J Virol.* 2016; 91(1):e01879-16. Published 2016 Dec. 16. The genomes of PCV3 strains are described in, e.g., Fan S et al. *Genome Announc.* 2017; 5(15):e00100-17. doi:10.1128/genomeA.00100-17 and Tochetto et al. Transbound Emerg Dis. 2018 February; 65(1):5-9. Epub 2017 Oct. 12. The genomic sequence of PCV3/CN/Hubei-618/2016 has been deposited at GenBank under the accession number KY354039. Additional strains are recorded under GBANs KX458235, KY996344, and KY96345 (Fux R et al. *Virol J.* 2018; 15(1):25). Additional aspects of PCV3 biology are described in, e.g., Li G, et al. *Adv Sci (Weinh).* 2018; 5(9):1800275. Classification of PCVs is still a challenging and evolving field. SFE Fux R et al. *Virol J.* 2018; 15(1):25. Published 2018 Jan. 29. Accordingly, current limits of classification & nomenclature should not limit the scope of PCV-related aspects.

In AOTI, a PCV3 Ag comprises one or more PCV3a Ags, one or more PCV3b Ags, or a combination of at least one of each such type of PCV3 Ag.

In aspects, a PCV3 Ag EP will comprise a PCV3 ORF1 sequence, a PCV3 ORF2 sequence, a fragment of either or both, or a variant of any or all thereof. ORF1 encodes for Rep and Rep' proteins involved in replication initiation. ORF2 encodes the Cap structural protein. PCV3 Ag EPs can comprise any combination of Rep, Rep', and Cap sequences. In AOTI, a PCV3 Ag EP comprises a Cap protein having a sequence RVRHRSIOI to SEQ ID NO:728, a fragment thereof, or a functional variant of either thereof. In aspects, a PCV3 Ag EP comprises a Rep Ag having a sequence RVRHRSIOI to SEQ ID NO:727, an antigenic fragment thereof, or a variant of either thereof. In aspects, a PCV3 Ag is one of the PCV3 Ags described in US20180305410, such as SEQ ID No. 2, 4, 6, or 8 thereof, or any combination thereof. In aspects, a PCV3 Ag EP comprises SEQ ID NO:6 of the '410 application.

In aspects, a PCV3 Ag also or alternatively comprises a truncated Rep protein or other PCV Ag homolog, such those that occur in PCV3-CN2018LN-4 (MH277118). SFE Ha Z et al. *BMC Vet Res.* 2018; 14(1):321. Compared to a highly diverse PCV3 strain (GD2016-1, KY421347), five Vietnamese PCV3 strains contained 39-point nucleotide mutations in the Cap-encoding sequence and 9 of those were non-synonymous. Nguyen V G, Chung H C, Huynh T M L, et al. (2018) Molecular Characterization of Novel Porcine Circovirus 3 (PCV3) in Pig Populations in the North of Vietnam. Arch Gene Genome Res 1(1):24-32. Any variations also can be used to design consensus sequence PCV3 variant Ags.

In AOTI, one or more PCV3 Ags are deglycosylation site variants. Examples of such variants of a Rep protein, for example, include sequences RVRHRSIOR to one or more of SEQ ID NOs. 724-726.

In aspects, one or more PCV3 Ags are from PCV3/CN/Hubei-618/2016, PCV3/USA/MO2015 (Genbank Accession No. (GBAN) KX778720.1), PCV3/USA/SD2016 (GBAN KX966193.1), PCV3/USA/MN2016 (GBAN KX898030.1), PCV3/USA/29160 (GBAN NC031753.1), PCV3/USA/2164 (GBAN KX458235.1), and PCV3/USA/29160 (GBAN KT869077.1).

In AOTI, a PCV3 Ag will also promote, induce, or enhance a detectable or significant response against one or more types of PCV2. In aspects, an EP can comprise one or more PCV2 Ags that detectably or significantly induce an immune response against PCV3. In aspects, one, some, most, or all of the PCV3 Ags in an EP will not induce a significant response against PCV2 or vice versa. A PCV3 Ag EP can comprise any suitable PCV3 Ag(s) from any suitable PCV3 & of any suitable PCV3 PPT, FF, or related PPT.

In aspects, a PCV3 Ag EPESC detectably or significantly induces an immune response against one or more strains of PCV3, such as one or more T cell responses, B cell responses or both. In aspects, a PCV3 Ag EP comprises at least one MHC I epitope, at least one MHC II epitope, or both types of epitopes. In aspects, a PCV3 Ag EP also or alternatively comprises at least one B cell epitope. In aspects, an effective amount of a PCV3 Ag EPESC detectably or significantly reduces the amount of PCV3 nucleic acid measured in PCV3 infected or challenged pigs (e.g., by qPCR). In aspects, an effective amount of a PCV3 Ag EPESC detectably or significantly reduces the amount of PCV Ag detected in PCV3 infected or challenged pigs, such as by immunohistochemistry (IHC) analysis, ELISA, and the like.

In aspects, an effective amount of a PCV3 Ag EPESC detectably or significantly reduces PCV3-associated porcine dermatitis and nephropathy syndrome (PDNS), reproductive failure, or both. In aspects, an effective amount of a PCV3 Ag EPESC detectably or significantly reduces the number of abortive fetuses in PCV3 infected pigs. In aspects, an effective amount of a PCV3 Ag EPESC detectably or significantly reduces histologic lesions in PCV3 infected or challenged pigs. In aspects, an effective amount of a PCV3 Ag EPESC detectably or significantly reduces viremia, viral shedding, lesions or gross lesions, incidence of swelling (moderate/severe swelling) or discoloration of lymphoid tissues, multisystemic inflammation, myocarditis, or a combination of any or all thereof in PCV3 infected or challenged pigs. In aspects, an effective amount of a PCV3 Ag EPESC detectably or significantly reduces porcine respiratory disease complex (PRDC) or one or more symptoms thereof such as coughing, dyspnea, fever, anorexia, gastro-intestinal disorders (e.g., diarrhea), or tremors in PCV3 challenged or infected pigs. Aspects of some of such phenomena in PCV3 infected pigs are described in, e.g., Klaumann F et al. *Front Vet Sci.* 2018; 5:315.

In aspects, a PCV3 Ag EPESC is delivered one or more times to piglets as a preventive treatment/vaccine, such as any of the ages described above with respect to PCV2 methods. In aspects, a PCV3 Ag EPESC is delivered as a therapeutic to PCV3 infected pigs. In aspects, a PCV3 Ag EPESC is combined with one or more other PCV3 vaccines or PCV3 treatments, in combined dosage forms or associated treatment methods.

In aspects, a PCV3 Ag EP comprises one or more putative PCV3 CRAs. In aspects, a PCV3 Ag EP comprises one or more CRAs that were established as CRAs by practicing CRA-identification methods provided herein.

In aspects, a PCV3 Ag EP comprises one or more heterologous Ags associated with typical PCV3 co-infections. In aspects, a PCV3 Ag EP comprises one or more porcine parvovirus Ags, such as one or more PPV6 Ags, PPV7 Ags, or PPV6 and PPV7 Ags.

2) PRRSV—Porcine Reproductive and Respiratory Syndrome Virus

In aspects, CEPs comprise Ag(s) of, related to, and that induce IR(s) against PRRSV (PRRSV Ag(s)). A PRRSV AgES CEPESC can comprise any suitable number of PRRSV AgES(s) encoding PRRSV Ag(s) from any suitable type of PRRSV and PRRSV PPT(s). In aspects, a PRSSV AgES CEPESC encodes 1+ or 2+PE(s) comprising 2+ PRRSV Ag(s). In aspects, SMGAOA Ag(s) in such PE(s) are bound by linkers (e.g., FLs, MSLs, or MSFLs), AW cleavage sites (e.g., SCS/2A sites), or both. In aspects, OSMGAOA Ag(s) of PRRSV Ag PE(s) are AW one or more ITS(s), e.g., PTPS(s), e.g., polyUb sequence(s).

PRRSV Ag CEPs can comprise Ag(s) of or related to any suitable type of PRRSV, any suitable strain of PRRSV, & any suitable PPT. In aspects, a PRRSV Ag EP comprises one or more type 1 PRRSV Ags, one or more type 2 PRRSV Ags, or both type 1 and type PRRSV Ags. In aspects, an EP comprises one or more Ags of a type 1 PRRSV strain, such as PRRSV-1 Lelystad (GenBank accession #M96262). In aspects, an EP comprises one or more Ags of a type 2 PRRSV strain, such as type 2 PRRSV strain VR-2332 (GenBank accession #AY150564). New PRRSV strains continue to be identified and Ags from such new strains can also or alternatively be used in PRRSV Ag EPs. SFE Chen N et al. Transbound Emerg Dis. 2019; 66(1):28-34.

In aspects, a PRRSV Ag EP comprises an AARS comprising some, most or all of a PRRSV ORF1a (e.g., comprising some, most, generally all or all of one or more of nsp1α, nsp1β, or nsp2) or an at least related variant sequence. In aspects, a PRRSV Ag EP also or alternatively comprises an AARS comprising some, most or all of a PRRSV ORF1a'-TF (e.g., comprising some, most, generally all, or all of one or both of nsp2TF or nsp2N) or an at least related variant thereof. In aspects, a PRRSV Ag EP also or alternatively comprises an AARS comprising some, most or all of a PRRSV ORF1a (e.g., some, most, generally all, or all of one or more of nsp3, nsp4, nsp5, nps6, nsp8, nsp7a, and nsp7p). In aspects, a PRRSV Ag EP also or alternatively comprises an AARS comprising some, most or all of a PRRSV ORF1b (e.g., some, most, generally all, or all of one or more of nsp9, nsp10, nsp11, and nsp12). In aspects, a PRRSV EP also or alternatively comprises an AARS comprising some, most or all of a PRRSV ORF2a/GP2a sequence. In aspects, a PRRSV Ag EP also or alternatively comprises an AARS comprising some, most or all of a PRRSV ORF2b/protein E sequence. In AOTI, PRRSV Ag(s) comprise SMGAOA of a PRRSV ORF4/GP4 PPT. In aspects, PRRSV Ag EPs comprise SMGAOA of a PRRSV ORF5/GP5 PPT. In aspects, a PRRSV Ag EP also or alternatively comprises an AARS comprising SMGAOA of a PRRSV ORF5a PPT. In aspects, a PRRSV Ag EP comprises SMGAOA of a PRRSV ORF6/protein M PPT.

In aspects, a PRRSV Ag EP comprises a PRRSV ORF3/GP3 PPT Ag, a PRRSV ORF7/protein N PPT Ag, or a combination thereof, optionally in combination with any of the above-described PRRSV Ag(s). In AOTI, a PRRSV Ag EP comprises PRRSV ORF3 Ag(s). In aspects, a PRRSV Ag EP comprises one or more PE(s) (optionally comprising MSLs, FLs, MSFLS, or SCSs or comprising one or more Ag-associated ITS, e.g., PTPS(s), e.g., polyUb(s). A PRRSV AgES CEPESC can comprise a non-gD PCI, an ICSTAP, or both. In aspects, NAMs of a PRRSV AgES CEPESC are plasmids associated with CaPNPs.

In an exemplary aspect, a PRRSV Ag EP comprises at least one AARS that is at least about 80% or at least about 90% identical, such as at least about 95%, 97%, or 99% identical to an at least 8 amino acid sequence, at least 12 AARS, at least 15 AARS, or ≥20 AARS contained in SEQ ID NO:11 that induces DOS IR(s) against PRRSV when expressed in TR(s). In aspects, a PRRSV Ag EP comprises ≥50 AAs, ≥100 AAs, or most, generally all, substantially all, or all (MGASAOA) of SEQ ID NO:11.

In aspects, a PRRSV Ag EP comprises a variant Ag AARS. In aspects, a PRRSV AgV EP comprises GSRV(s). In aspects, a PRRSV Ag EP comprises a GSRV of a PRRSV GP2a-b, GP3, GP4, GP5, GP5a, M, or N protein, or CT. In aspects, a PRRSV Ag EP comprises SEQ ID NO:13 or a fragment comprising at least 25% most generally all, of or substantially all thereof. In aspects, a PRRSV Ag EP EP comprises SEQ ID NO:12 or a fragment comprising at least about 10 AAs, at least about 20 AAs, at least about 25 AAs, at least about 50 AAs, most, generally all, or substantially all thereof. In aspects, a PRRSV also or alternatively comprises a variant in which a decoy epitope (e.g., a decoy epitope in the M protein or GP5) is removed via AA substitution or deletion (SFE U.S. Pat. No. 9,441,015 and AOTI DEH).

In aspects, a PRRSV Ag EP comprises one or more PRRSV T cell epitopes (e.g., SEQ ID NO:668); see also CN103242427A). In aspects, a PRRSV Ag EP comprises MHCIE(s), MHCIIE(s), or CT. In aspects, a PRRSV Ag EP also or alternatively comprises one or more BCE(s) (e.g., SEQ ID NO:669); see also Chen Z et al. J Gen Virol. 2010; 91(Pt 4):1047-1057; An T Q et al. Virus Genes. 2005; 31(1):81-87; de Lima M et al. Virology. 2006; 353(2):410-421; Oleksiewicz M B et al. J Virol. 2001; 75(7):3277-3290; CN109554375A; and Shi X et al. Int J Biol Macromol. 2019; 139:1288-1294). PRRSV epitopes have been identified and others have been predicted. Any suitable one or more of such PRRSV epitopes can be contained in PRRSV Ag EPs. Additional PRRSV epitopes (including mimotopes), AgES constructs, strains, and methods are KITA and ATAOTI. SFE Pan X et al Front Immunol. 2020; 10:2995. doi:10.3389/fimmu.2019.02995; WO2007062851; EP1882696; EP2457583; US20120040335; US20110293655; CN102488895; CN103421817; CN105671064; Chen C et al. Vaccine. 2013; 31(14):1838-1847. doi:10.1016/j.vaccine.2013.01.049; U.S. Pat. No. 8,182,984; U.S. Ser. No. 10/300,123; & Oleksiewicz M B et al. J Gen Virol. 2002; 83(Pt 6):1407-1418; R. Parida. Cell-Mediated Immunity in Porcine Reproductive and Respiratory Syndrome Virus Syndrome Virus. Available at digitalcommons.unl.edu; & U.S. Pat. No. 7,465,455.

In aspects, PRRSV Ag CEPs comprises non-PRRSV Ag(s) from/related to DCA(s) that commonly co-infect swine with PRRSV. In AOTI, SMGAOA of non-PRRSV Ag(s) in such a CEP are PCV Ag(s). Combined PRRSV/PCV constructs and Ags KITA can be adapted to use in such CEPESCs. SFE CN103059142. In aspects, PRRSV AgES CEPESC(s) are delivered to PRRSV/PCV co-infected TR(s) (e.g., pigs) & the method DOS improves one or more virus infection symptoms or conditions in such pigs. Such conditions are described in, e.g., Jung K et al. J Gen Virol. 2009; 90(Pt 11):2713-2723. Additional examples of co-infections DCAs include *P. multocida, S. suis, H. parasuis*, porcine respiratory coronavirus (PRCV), *Mycoplasma hyopneumoniae* (*M. hyo*), and *Actinobacillus* pleuropneumonia (APP). Methods can comprise administration of two or more NAMs comprising, respectively, PRRSV Ag EPs and one or more such co-infectious DCA Ag EPs or associated administration of such EPESCs (alone or in combination with other vaccines or treatments). The invention also provides CEPESCs comprising one or more Ags against such agents, independently of any PRRSV Ags.

In aspects, a PRRSV Ag EP, PRRSV Ag EPESC, or both, induces one or more DOS IRs against one or more types of PRRSV. In aspects, the IR comprises an enhanced expression of one or more cytokines, such as IFNγ, IL-8, IL-1β, TGF-β, or a combination of any or all thereof. In aspects, an IR comprises an increase in proliferation, development, activity, or a COAOAT in one or more other ICs, such as B cells, NK cells, γδT cells early, and αβT cells. In aspects, the IR comprises a T cell immune response. Detection of T cell responses in PRRSV cases are exemplified in, e.g., Bautista E M, et al. Viral Immunol. 1997; 10(2):83-94. In aspects, an IR is an increase in IC frequency, e.g., T cell frequency, of at least 2×, at least 2.5×, or at least 3× over baseline in PRRSV infected or challenged pigs by 2-10 weeks post vaccination. In aspects, the IR comprises a DOS increase in NKC activity, such as NKC cytotoxicity. In aspects, the IR comprises a reduction in TReg suppression of anti-PRRSV responses. In aspects, the IR comprises a detectable or significantly enhanced memory immune response, an upregulation of anti-PRRSV macrophage activity, or both. In aspects, an IR leads to one or more reductions in PRRS frequency, severity, duration, or symptoms or clinical indicators, such as a detectable or significant reduction in shedding, viremia, or both. In aspects, an IR comprises a detectable or significantly lower rate of PRRSV co-infection. Other aspects of PRRSV effects on the immune system & PRRSV biology is provided in Lunney J K. Annu Rev Anim Biosci. 2016; 4:129-154.

In aspects, the delivery of EA(s) of PRRSV CEPESC(s) results in an at least as effective or DOS more effective IR(s) in one or more aspects, CE(s) in 1+ aspect(s) (individually or in a population), or both, WRT to on-market or otherwise described PRRSV vaccines, such as, e.g., FOSTERA® PRRS (Zoetis, USA) or OSMGAOA of the vaccines described in Taeyeon Kim et al. Clinical and Vaccine Immunology May 2015, 22 (6) 631-640 or Oh T, et al. Canadian Journal of Veterinary Research 2019 January; 83(1):57-67. In aspects, a PRRVS EPESC achieves such similar or improved IRs with less administrations than required to achieve such effects using such vaccines KITA.

4) Influenza

In aspects, CEPs comprises influenza virus ("IV") Ag(s). CEPs can comprise any suitable number of IV Ags AW any suitable kind of IV(s) and IV PPT(s). A CEP can comprise IV Ag(s) AW IVs that typically infect 1+ or 2+ species, such as swine influenza virus (SIV), canine influenza virus (CIV), avian influenza virus, or human influenza virus ("HSIV"—the abbreviation HSIV is used for human influenza viruses to avoid confusion with HIV). In aspects, a CEP comprises IV Ags AW IVs that AW with infections of 2+ species, such as dogs & humans; cats & humans; birds & humans; or CT (e.g., FIV Ags, CIV Ags, and HSIV Ags). This principle can AOA be applied to other viral conditions AW species-to-species transmission in other AOTI (e.g., PCV or COV). One AOTI is inhibition/reduction of species-to-species pathogen DCA transmissions, e.g., preventing from NHAs to humans or wild animals to domesticated NHAs.

IV Ag(s) can be from or related to any suitable type or subtype of IV. For example, HSIV Ags can be from or related to type A, type B, or type C HSIVs and can comprise Ags of any subtypes thereof (e.g., H1N1, H1N2, H3N2, or H7N2 HSIV Ags, or H10N8 Ags). In aspects, a CEP comprises multiple IV Ags from a species, multiple IV Ags from multiple species, or both. For example, a CEP can comprise H1N1, H1N2, H3N2, and H7N2 Ags; type A and type B HSIV Ags; or a combination thereof, or further subtypes thereof (e.g., pH1N1). An IV type A or type B Ag can be primarily associated with IVs that infect birds, pigs, horses, cats, dogs, humans, or non-human primates. In aspects an IV Ag CEP comprises an avian IV Ag, such as an H5N1 or H3N2 avian IV Ag. An IV Ag can be from any one of the IVs mentioned in the extensive list of IV strains and serotypes provided in WO2016205347.

In aspects, IV Ag(s) comprise a hemagglutinin (HA or H) AARS(s), such as an H1, H2, H3, H4, H5, H6, H7, H8, H9, H10, H11, H12, H13, H14, H15, H16, H17, or H18 AARS (as always, such AARSs also comprise FFs and FVs, e.g., editope variants, GSRVs, and the like). In aspects, the CEP comprises Ag(s) of or related to a HA head domain (HA1), and optionally lack or comprising a HA cytoplasmic domain, HA transmembrane domain, or a combination. In aspects, CEP(s) comprise Ag(s) from a H7N9 IV, a H10N8 IV, or CT. In AOTI, CEPs comprise flu year Ag(s). A "flu year antigen" is an antigen selected from a strain of HSIV used as a component of a yearly flu vaccine (e.g., strain A/Port Chalmers/1/1973(H3N2)-like virus, represents a strain component of the Northern Hemisphere vaccine from 1974-1975).

In AOTI, an IV Ag CEP comprises gDAgFP(s). In aspects an IV Ag CEP includes an ICITM(s)/ICSTAP(s), e.g., EAT-2 PPT(s). In aspects, IV Ag CEPs comprise NonCMIP(s), e.g., cytokine(s). In aspects, IV Ag CEPs comprise a NGDCI (e.g., a PD-L1 or CDR112R CI). In AOTI, IV Ag CEPs comprise a gDS that is a CI. In aspects, an IV Ag CEP comprises MgDS(s), such as in OSMOA gDAgFPs. In aspects, EP(s) of IV Ag CEPs are encoded on different NAMs.

In aspects, an IV Ag CEP comprises ≥2, e.g., 2-20, 3-30, 4-24, 5-25, 5-15, 2-12, 3-12, 4-12, or 5-10 IV Ags. In aspects, an IV Ag CEP comprises PE(s) PCGCOSCOOCO IV Ag(s). In aspects, OSMGAOA of the IV Ags of a CEP are associated with ITS(s), e.g., PTPS(s), e.g., polyUb(s). In AOTI, PE(s) comprise linkers (MSLs, FLs, or MSFLs), SCSs (e.g., 2a sites), or CT. In aspects, OSMOA of the Ags of an IV Ag CEP are contained in gDAgFPs.

In aspects, IV Ags of a CEP comprise MHCIE(s), MHCI-IE(s), or both, in aspects resulting in DOS CTL IR(s), TH IR(s), and BC IR(s). In aspects, CEP(s) comprise FVs in which BCE(s) are removed or lacks any known IV BCEs. In aspects, the CEP comprises IV BCE(s). In aspects, the CEP comprises DIV AgV(s). In aspects, the CEP comprises a mixture of immunodominant/IRV AVg(s) and subdominant Ag(s). In aspects, a CEP comprises cryptic IV Ag(s).

In aspects, an IV Ag CEP comprises TCE(s) against an internal IV protein, external IV protein, or both. In aspects, an IV Ag CEP comprises MHCIE(s) and MHCIIE(s) against an external IV protein, an internal IV protein, or both. In aspects, a CEP comprises a combination of two, three, or all four of such types of Ags. In aspects, a CEP comprises five or more of such Ags (e.g., 6, 8, 10, 12, 14, 16, or 20 such Ags) in two, three, four of such groupings. Examples of internal and external IV T cell epitopes are exemplified in, e.g., Savic M et al. Immunology. 2016; 147(2):165-177.

In aspects, an IV Ag CEP comprises unnatural immunity Ag(s) (SFE Scorza et al. Vaccine. 2016; 34(26):2926-2933and Nabel, supra). Other pathogen Ag(s) DEH or KITA and ATAOTI also can comprise unnatural immunity Ag(s).

In aspects, IV Ag(s) comprise IV serotype/strain cross-reactive epitopes. Examples of such epitopes are described in, e.g., Koutsakos M et al. Nat Immunol. 2019; 20(5):613-625. In aspects, a cross-protective IV Ag EP comprises HA stalk Ag(s) or AgV(s).

In aspects, IV Ags comprise IV Ags from IV strains that are predominately from different regions, such as different continents (e.g., Asia, N. America, or Europe) or different hemispheres (Northern and Southern or Eastern or Western). In aspects, IV Ags comprise one or more Ags in the Influenza Sequence and Epitope Database (ISED) (SFE Yang I S, et al. Nucleic Acids Res. 2009; 37.D423-D430.

In aspects, OSMGAOA of any HA IV Ag(s) of a CEP are at least partially glycosylated. In aspects, IV HA AgV(s) comprising GSRV(s) are provided, wherein OSMOA of the N-linked glycosylation sites are removed. In aspects, an HA IV Ag is from a H1, H3, or H5 IV. NLG sites of HA PPTs are exemplified in, e.g., Kim J et al. Yonsei Med J. 2012; 53(5):886-893. In aspects, IV Ag(s) comprise a glycosylated or partially glycosylated IV M2 PPT/AARS. In aspects, IV Ag(S) comprise M2 AgV(s) comprising GSRV(s). NLG sites of M2 PPTs are exemplified in e.g., Holsinger L J et al. J Virol. 1994; 68(3):1551-1563.

In aspects, an IV CEP comprises HA stalk domain ("SD"); matrix protein 1 (M1), matrix protein 2 (M2), or M2e (M2 epitope) Ags; or combinations. In aspects, an IV CEP also comprises IV nucleoprotein (NP) Ag(s) or AgV(s) (e.g., NP Ag(s) and M1 Ag(s); HA SD Ag(s) and M2 Ag(s); or HA SD, M1, M2, and NP Ag(s)). In aspects, a CEP will further comprise a neuraminidase (N) (N1 or N2) Ag. However, in other aspects, a CEP lacks any N Ag(s). In aspects, 2+ such Ag(s), 2+ portions of 1+ of such Ag(s), or both are from different types of IVs. In aspects, one type of such IV Ag is a chimera of HA1 and HA2 sequences, such as a HA1 SD and a HA2 HA head domain Ag (or vice versa). In an aspect, the CEP comprises a combination of 2, 3, or 4+HA Ag(s) comprising HA SD Ag(s), NP Ag(s) (e.g., AgV(s)), M1 Ag(s), and M2 Ag(s), comprising MHCIE(s) & MHCIIE(s), and optionally comprising ITS(s), e.g., polyUb(s). In aspects, IV Ag(s) comprise HA stalk domain AARS(s) Ag(s)/AgV(s); HA head domain AARS(s) Ag(s)/AgV(s), neuraminidase (N) stalk domain Ag(s)/AgV(s), or N head domain Ag(s)/AgV(s). An exemplary HA stalk domain Ag is described in Mallajosyula et al. PNAS (2014) E2514-E2523. IV Ags can PC, GCO, SCO, consist essentially of, or CO such domains, such as being "headless" sequences, soluble HA Ag sequences, and the like.

In AOTI, IV Ag CEPs comprise anti-IV Ab AARS(s) directed to any suitable IV Ag. Examples of such Abs are KITA (SFE US20190062407 and WO202004154). In aspects, such anti-IV Ab sequences form part of a NGDFP. In AOTI, NGDFP(s) comprises IV Ag(s), and optionally ITS(s) (e.g., polyUb(s)).

In aspects, the CEP comprises AgV(s), such as editopes, GSRAgV(s), DIV AgV(s), synthetic AgV(s) developed through mutagenesis or directed evolution (see, e.g, AU2002027676), chimeric AgV(s) (e.g., AgV(s) comprising IV Ag AARS(s) of strains of risk of cross-species transmission), and AgV(s) developed from consensus sequences of IV Ags. In an aspect, a HA loop-forming sequence, such as KRRSNKS (SEQ ID NO:733), is substituted with a GSRV or other variant (e.g., a string of two to eight Gly residues). In aspects, a HA AgV comprises a modification that disrupts a site B helix, formed by, e.g., SEQ ID NOs:670 & 671. In aspects, such modifications introduce a glycosylation site, by, e.g., using NAS to replace QIS; substituting NIT for SLY; substituting NST for KYK; or substituting NTS for YKY at 159. CD4 IV Ags include SEQ ID NOs:672-676 (or FFs/FVs). Known CD8 IV epitopes include SEQ ID NOs: 677-680 (& FFs/FVs). Examples of known H1N1 epitopes include SEQ ID NOs:681-683 (& FFs/FVs). Additional IV epitopes include SEQ ID NOs:684-691 & FFs/FVs thereof. In aspects, IV CEPs lack epitopes that exhibit a prevalence of more than about 40%, 50%, 60%, 70%, or 80% but exhibit serotype coverage of less than about 15%, ≤20%, or ≤25% (such principles can be applied to other viral Ag CEPESCs OTI). In aspects, CEPs comprise CD8 IV epitope(s) identified with the top 25%, 33%, or 50% of IFNg, IL-2, or TNFalpha CD4TC counts, CD8 TC counts, or both in TR(s), e.g., as reported in Savic et al, supra.

In aspects, a CIV Ag CEP comprises ICSTAP(s)/ICITM(s) such as an EAT-2 PPT, SAP PPT, or CT. In aspects, an IV AgES CEP comprises gDS CI(s). In aspects, EP comprise NGDCI(s), e.g., a PD-1/PD-L1 CI or CD112R CI.

In aspects, IV Ag(s) are associated with ITS(s), e.g., PTPS(s), e.g., polyUb(s). In aspects, OSMOA of IV Ag(s) are contained in gDAgFP(s) in CEPs.

In AOTI, CEPES(s) are contained in 2+ NAMs comprising different EPES(s), 1+ of the EPs comprising gDAgFP(s) and a $2^{nd}$ NAM EP comprising a 2nd gDP, ICSTAP(s)/ICITM(s), NCMIP(s), Ag(s), NGDICRTSAgFPs, or CT.

In aspects, CIV AgES EPECS(s) are contained in viral vectors, such as an Ad vector, MMLV vector, etc. As with any other viral Ag aspects, In AOTI, such CIV AgES EPEC(s) can be delivered in a non-pathogenic viral vector derived from the DCA or a related virus (i.e., an IV vector). In aspects, CIV AgES CEPES(s) are contained in nucleic acid vectors. In aspects, the CEPNAMs comprise EEI(s). In aspects, the vectors are mRNA vectors. In aspects, the vectors are plasmid DNA vectors associated with a TFA, such as a CaPNP.

In aspects, CaPNP(s) of a CaPNP-associated NAV CEPESC exhibit DOS higher hemagglutination inhibition, virus neutralization, anti-IV IgG antibody titers, or CT, than without the CaPNP(s). In aspects, such CEPESCs are administered by mucosal administration, e.g., in NHA TR(s) (e.g., pulmonary, intranasal, intravaginal, or CTs). Such aspects apply to any CaPNP-plasmid aspects of this disclosure and are not limited to IV AgES CEPESCs.

In aspects, delivering an EA of a CEPESC comprising IV AgES(s) induces IR(s) against one or more IV(s). In aspects delivering an EA of a CEPESC comprising IV AgES(s) induces DOS CE(s) relating to IV infection, such as DOS reduction in viral shedding, DOS reduction in viremia, or DOS reduction in IV-related nucleic acids in the host. In aspects, an EA of CEPESC comprising IV AgES(s) results in a DOS reduction in IV infection when initially administered more than 48 hours after infection. In aspects, administration of an EA of a CEPESC comprising IV AgES(s) results in a DOS reduction in one or more IV infection-associated symptoms, such as dry cough, fever, chills, myalgias progressing to respiratory failure, and secondary bacterial infections (e.g., MRSA). In aspects, a single administration of an EA of a CEPESC comprising IV AgES(s) provides protection in a significant proportion of a population for an entire flu season or multiple seasons. In aspects, an IV AgES CEPESC induces a DOS improved immunological memory in one or more aspects as compared to one or more IV vaccines in the prior art, such as OSMOA of the on-market IV vaccines (e.g., Fluarix, Fluarix Quadrivalent, FluLaval, Fluzone, or Fluzone Quadrivalent (for HSIV); Nobivac® for CIV; or Ingelvac Provenza™ for SIV. In aspects, the method results in a significant IR against IV in about 14 days or less, about 10 days or less, or about 7 days or less. In aspects, inducing anti-IFV IRs by delivering IV AgES CEPESCs comprises administering a booster dose after e.g., 2-4 weeks, 2 months, 3 months, 6 months, or 1, 2, 3, 5, or 10 years (e.g., 2-52 weeks, 1-36 months, or 1-5 years). In aspects, an IV AgES CEPESC is administered in a CC comprising an anti-IV vaccine or an anti-IV therapeutic. In aspects, an IV AgES CEPESC is administered in association with an anti-IV vaccine or anti-IV therapy. In AOTI, such methods DOS B cell & T cell IRs.

IVs are extensively studies and numerous IV Ags, epitopes, and related compositions and techniques are KITA. Examples of references with disclosures ATAOTI are U.S. Ser. No. 10/022,435, U.S. Pat. No. 8,470,771, U.S. Ser. No. 10/543,268, U.S. Ser. No. 10/596,250, U.S. Ser. No. 10/584, 148, U.S. Ser. No. 10/286,061, US2016020796, US20190275137, US20190321460, US20190134185, US20150086560, US20190201519, WO2016205347, WO2016178811, Gutiérrez A H et al. Influenza Other Respir Viruses. 2017; 11(6):531-542. doi:10.1111/irv.12513; and Rimmelzwaan G F et al. Vaccine. 2009; 27(45):6363-6365.

In aspects, an IV AgES CEPESC comprises IV Ag(s) of an IV(s) primarily infects NHAs. In aspects, SMGAOA IV Ag(s) of a CEP are Ags of NHA IVs. In AOTI, OSMOA of the IV Ags of an EP are CIV Ags. In aspects, a CEP comprises H3N2 CIV Ag(s), H3N8 CIV Ag(s), or CT. In aspects, CEPs comprise MHCIE(s) & MCHIIE(s) against H3N2 or H3N8 or both, or either or both in combination with Ags of/related to PPTs of H1N1, H5N1, H3N1, or CT. In aspects, delivery of an EA of such a CEPESC DOS reduces indicators of CIV in TR(s), such as viral shedding; symptoms of CIV, such as cough, runny nose, fever, lethargy, eye discharge and reduced appetite; or both. In aspects, such a product is delivered to canines with no capability to mount DOS IR(s) to one or more strains of CIV associated with OSMOA of the CIV Ag(s) in the EP.

In AOTI, CEPESCs express IV Ag(s) AW commercial poultry, dogs, or both. In aspects, such CEPESCs comprise AgES(s) encoding H7N2 IV Ag(s).

In AOTI, CEPESCs expressing IV Ag(s) exhibit DOS IR(s) on challenge with IV(s) after at least ~6 months, ≥12 months, ≥18 months, ≥~2 years, ≥~3 years, or at least about 5 years. In aspects, treated TRs comprise a DOS amount of Ag-specific T memory cells associated with Ag(s) in the EP.

In aspects, a CIV AgES CEP comprises a gDS CI. In aspects, an EP also comprises a NGDCI, such as a PD-1 CI, PD-L1 CI, or a CD112R CI.

In aspects, CIV Ags are associated with ITS(s), such as PTPS(s), e.g., polyUb(s). In aspects, OSMGAOA of such CIV Ags in gDAgFP(s) in the EP. In AOTI, CIV Ag CEPs comprise ICSTAP(s)/ITICITM(s) e.g., EAT-2 PPT(s).

In aspects, an IV AgES CEP comprises a gDS CI. In aspects, an EP also comprises a NGDCI, such as a PD-1 CI, PD-L1 CI, or a CD112R CI.

In AOTI, CIV AgES NAM(s) are NAV(s). In aspects, NAV(s) are mRNA vectors. In aspects, NAV(s) are plasmid DNA vectors associated with a TFA, such as a CaPNP. In aspects, CEPESC NAM(s) comprise EEI(s).

In aspects, CIV AgES CEPES(s) are contained in 2+ NAM(s) comprising different EPESs, at least one of the EPs comprising gDAgFP(s) and a 2nd EP comprising a different gDP, ICSTAP(s), NCI CIV Ag(s), NGDICRTSAgFPs, or combinations.

In aspects, a CIV Ag EP will comprise CIV HA SD Ag(s), NP Ag(s), M1 Ag(s), M2 Ag(s), or a combination of two, three, or all four thereof (e.g., HA SD/NP/M1/M2 or NP/M1/M2). In aspects, such Ag(s) will comprise MHCI and MHCII Ags. In aspects, OSMOA of such CIV Ag(s) are in gDAgFP(s) of the CEP. In aspects, OSMOA of such Ag(s) are associated with ITS(s), such as polyUb(s). In aspects, the CEP comprises an ITII, such as an EAT-2 PPT. In aspects, the EPs comprise one or more 2A sites, MSLs, FLs, or combinations. In aspects, an EA of any such CEPESC exhibits DOS IR(s) or CE(s) as compared to administration of Nobivac® Canine Flu Bivalent Vaccine. In aspects, delivery of an EA of any such CEPESC results in a DOS increase in IFNgamma in TRs.

5) Pseudorabies Virus

In aspects, CEPs comprise pseudorabies virus (PRV) Ag(s). PRV is an alphaherpesvirus and is aka as suid herpesvirus 1 (SuHV1) and Aujeszky's disease virus (ADV) (in reference to a disorder caused by PRV). PRV is interspecies transmissible/zoontic, being indicated infections of other animals such as cows and horses, and recently shown to have infect humans. SFE Yang X et al. Int J Infect Dis. 2019; 87:92-99. doi:10.1016/j.ijid.2019.08.007.

PRV AgES CEPESCs can comprise PRV Ag AgES(s) encoding any suitable types of PRV Ag(s) from any suitable type of PRV & PRV PPTs. Numerous PRV strains are KITA. SFE Zhai X et al. Virol Sin. 2019; 34(6):601-609; Verpoest S et al. 2014; 172(1-2):72-77; Tong W et al. Vet Microbiol. 2015; 181(3-4):236-240; Tang Y D et al. Sci Rep. 2017; 7(1):7783; Yu X et al. Emerg Infect Dis. 2014; 20(1):102-104; Wu R et al. J Vet Sci. 2013; 14(3):363-365; and Sun Y et al. Peer J. 2018; 6:e5785. CEPs can comprise PRV Ag(s) from or related to any Ag(s) of such strains or other PRV strain(s).

PRV Ag(s) in CEP(s) can include PRV Ag(s) of or that are related to any suitable PRV PPTs. In aspects, PRV Ag(s) in CEP(s) comprise PRV gB Ag(s), PRV gC Ag(s), PRV gD Ag(s), PRV gE Ag(s) or combinations. In aspects, CEP(s) do not comprise any PRV gD Ag(s). In aspects, PRV gDS(s) in CEP(s) are used to induce gDS functions, such as porcine nectin-1 receptor (e.g., in a PRV gDS or PRV gD-related gDS gDAgFP(s) in the CEP). In aspects, such PRV gDS(s) or PRV-related gDS(s) are the only gDS(s) in the CEP. PRV Ag(s) can include other suitable PRV PPT(s) or AARS(s). Such PPT(s)/AARS(s) and additional relevant aspects of PRV biology that can be adapted or applied to methods/ compositions of related aspects of the invention are described in, e.g., Klupp B G et al. J Virol. 2004 February; 78(4):2166 and J Virol. 2004; 78(1):424-440; Ye C et al. Virol J. 2018; 15(1):195. Published 2018 Dec. 29; Pomeranz et al. Microbiol Mol Biol Rev. 2005; 69(3):462-500; Chinsakchai S et al. 1994; 43(1-3):107-116; Stegeman A, et al. Vet Q. 1997; 19(3):117-122; and Pomeranz L E et al. Microbiol Mol Biol Rev. 2005; 69(3):462-500.

In aspects, PRV Ag CEP(s) comprise TCE(s). In aspects, PRV Ag CEP(s) comprise MHCIE(s) & MHCIIE(s). In aspects, PRV gC TCE(s) are VRHRSIOI to 1 or both of SEQ ID NOs:692 & 693.

In aspects, a PRV-related EP comprises PRV PCRA(s).

In aspects, PRV Ag CEP(s) comprise PRV BCE(s). Examples of PRV BCE(s), BC Ag(s), and PRV Ab(s) are KITA and ATAOTI. SFE Zhang P et al. Vet Microbiol. 2019; 234:83-91; Zaripov M M et al. J Gen Virol 1999 August; 80(Pt 8):2285 and J Gen Virol. 1999; 80 (Pt 3):537-541; Jacobs L et al. J Gen Virol. 1990; 71 (Pt 4):881-887; Jacobs L et al. Clin Diagn Lab Immunol. 1994; 1(5):500-505; Li X et al. PLOS Pathogens 13(12): e1006777; Morenkov O S et al. Virus Res. 1997; 51(1):65-79; Coe N E et al. Arch Virol. 1990; 110(1-2):137-142; and Xu J J et al. Biochem Biophys Res Commun. 2019; 519(2):330-336. In aspects, Abs or Ab AARS(s) from such Ab(s) are also within the CEP. E.g., such Ab AARS(s) can be incorporated into FPs comprising one or more PRV Ag(s) in a CEP or in or expressed by a composition administered in association with PRV Ag CEPESC(s). Additional PRV Ags and related PMCs ATAOTI comprising PRV AgES CEPESC(s) are described in, e.g., U.S. Pat. No. 5,449,765; CN107163108; and CN104628865.

In aspects, PRV Ag CEPs comprise PRV AgV(s). In aspects, AgV(s) comprise GSRV(s) or DIVs. In aspects, PRV AgV(s) include editope(s) (e.g., improved MHC affinity AgV(s)).

In aspects, PRV Ag(s) are associated with ITS(s). In aspects, ITS(s) in the CEP comprise PTPS(s). In aspects, PTPS(s) comprise polyUb(s).

In aspects, a PRV CEP comprises ICSTAP(s)/ITICITM(s). In aspects, ICSTAP(s) comprise EAT-2 PPT(s). In methods, ICITSTAP(s) or ES(s) are AAW delivery of PRV AgES CEPESC(s), e.g., prior to initial CEPESC dosing.

In aspects, PRV CEP comprises NGDCI(s). In aspects, NGDCI(s) include PD-1, PD-1, or CD112R CI(s). In aspects, NGDCI(s) are non-Ab multimeric PPT, such as a trap PPT. In methods, NGDCI(s) are AAW or expressed from NAM(s) delivered in association with PRV AgES CEPESC(s).

In aspects, PRV CEPs comprise NCMIMP(s), such as cytokine(s), e.g., IFNgamma. In aspects here and WRT to other methods herein SMGAOA NCMIMP(s) are not ICSTAP(s) or ITICITM(s). In other aspects NCMIMP(s) ACA ICSTAP(s)/ITICIMP(s). In methods, NCMIMP(s) are administered or related ES(s) delivered in AW the delivery of an EA of PRV AgES CEPESC(s).

In aspects, CEPs comprise PIM(s) that DOS (a) upregulates an NKG2D ligand (e.g., MULT-1, H60, or RAE-1E); (b) reduces NKG2D inhibition; (c) enhances NKG2D activity; or (d) upregulates NKG2D expression. Aspects can include other modulator(s) of NKG2D activity, NKG2D activity inhibitor(s).

In aspects, OSMGAOA of PRV Ag(s) of a CEP are contained in gDAgFP(s). In aspects, OSMGAOA of PRV Ag(s) of a CEP are contained in other FP(s), such as PE FP(s), Ag:ITS FP(s), FP(s) comprising NGDICRTS(s), or CT.

In aspects, PRV Ag CEsP comprise 2+ gDPs. In AOTI, PRV Ag CEPs comprise multiple gDAgFP(s). In AOTI, PRV Ag CEP(s) comprise MgDS(s).

In aspects, a PRV Ag CEP comprises gDAgFP(s) comprising gDS(s) that exhibit a higher level of relatedness, similarity, or both to a PRV gD than a human alphaherpesvirus gD. In aspects, gDAgFP(s) comprise a gDS that is RVRHRSI, SVSHSSCE, or both to ≥1 of SEQ ID NOs:694-696. In aspects, gDS(s) comprise gDS(s) that bind porcine nectin-1 with suitable, comparable, or improved affinity as compared to WT PRV gD, HSV-1 gD, HSV-2 gD, or CT. pNectin-1 binding is described in, e.g., Li A et al. PLoS Pathog. 2017; 13(5):e1006314 and Zago A et al. PNAS 2004; 101(50):17498-17503.

In aspects, PRV Ag EPES(s) comprise EEI(s), e.g., CMV Intron A.

In aspects, PRV Ag EPES(s) are contained in NAV(s). In aspects, EPES(s) are contained in viral vector(s), e.g., viral vectors with high transfection rates in 2+ types of TR(s) (e.g., Ad5 vectors for humans and pigs). In aspects, PRV Ag EPES(s) are delivered in a PRV-derived vector (such vectors are described in, e.g., Tan F et al. Methods Mol Biol. 2017; 1581:79-96). In aspects, OSMOA of the vectors are NAV(s). In aspects, NAV(s) comprise mRNA vector(s). In aspects, OSMOA of the vectors are TFA-associated vectors, such as CaPNP-associated plasmids.

In aspects, PRV AgES CEPESC(s) are combined in CC(s) or administered in association with anti-PRV therapeutics, anti-PRV vaccines, or both. Examples of PRV vaccines are described in, e.g., Freuling C M et al. Vaccines against pseudorabies virus (PrV). Vet Microbiol. 2017; 206:3-9. Examples of CCCs used in viral infections, such as PRV infections, include delivery of EA(s) of immunoglobulin, glucocorticoids, antiviral agents, and symptomatic supportive treatments.

In aspects, a PRV AgES CEPESC induces IR(s) in TR(s). In aspects, such IR(s) comprise DOS modulation of NKC activity, such as DOS enhanced MHCII expression, DOS increases in NKC co-stimulatory molecule expression (e.g., CD80/86 expression), or both; DOS enhanced NKC cytotoxicity; or DOS enhanced NKC cytokine production. In aspects, IR(s) comprise DOS proliferation of PRV Ag-specific T cells, such as CD4, CD8, or both CD4 & CD8 T cells. In aspects, IR(s) comprise DOS proliferation of PRV Ag-specific memory T cells. In aspects, IR(s) comprise DOS killing of PRV-infected cells, a reduction in PRV-associated nucleic acids in TR cells/serum, or both. In aspects, IR(s) comprise reduced PRV shedding, reduced PRV Ag in serum/TRs, or both In aspects, a PRV AgES CEPESC induces DOS anti-PRV CE(s). In aspects, CE(s) include DOS reduction in PRV-associated pregnancy failures (abortions, stillbirths, etc.) or reduced pregnancy/fertility (live offspring) rates. In aspects, CE(s) comprise DOS reduction in fever, coughing, sneezing, anorexia, excess salivation, seizures, constipation, depression, ataxia, circling, pneumonia, and respiratory failure/issues. In aspects, CE(s) comprise reduction in lesions (e.g., gross of focal hepatic, pulmonary, and splenic necrosis and necrotic tonsillitis or reduction of lesions/microscopic lesion in the nervous system). In aspects, CE(s) include reduced meningoencephalitis, ganglioneuritis, and perivascular cuffing by mononuclear cells. In aspects, CE(s) comprise increased piglet survival rates. In aspects, CEPESC(s) are delivered to pigs under 2 months, 6 weeks, or 1 month in age.

6) ASFV (African Swine Fever Virus)

In aspects, CEP(s) comprise Ag(s) of or related to African Swine Fever Virus (ASFV). An ASFV Ag CEP can comprise any suitable number of any suitable type of ASFV Ag(s) (e.g., 1, 2, 3, 5, 7, 8, 10, 12, 15, or more ASFV Ag(s)). ASFV Ag(s) can be from any type of ASFV, such as any of ASFV serotypes 1-8, any of the 24 currently known ASFV genotypes, or comprising AARSs encoded by any of the 39 ASFV strains in GenBank, or combinations (SFE Malogolovkin A et al. Emerg Infect Dis. 2015; 21(2):312-315 and Gaudreault N N et al. Vaccines (Basel). 2019; 7(2):56. Published 2019 Jun. 25). ASFV Ag(s) can include Ag(s) from any of the currently known 68 ASFV structural proteins, or approximately 80 nonstructural proteins. In aspects, a CEP comprises ASFV Ag(s) that are cross-protective against two or more types of ASFV, such as two or more ASFV strains within a serotype. ASFV Ag(s) also can be from or be related to any Ag of any of the ASFV strains maintained at the National Research Institute for Veterinary Virology and Microbiology (VNIIVViM) in Pokrov, Russia, many of which are publicly available (SFE Malogolovkin A et al. Emerg Infect Dis. 2015; 21(2):312-315). In aspects, ASFV Ags of a CEP are encoded by ASFV early genes, intermediate genes, late genes, or two or all thereof. Additional ASFV strains, proteins, etc., ATAOTI are described in e.g., Alejo A. et al. J Virol 92:e01293-18; Almazon F. et al.

1992. J Virol. November; 66(11):6655-67 PMID:1404609; de Villers E. et al., 2010. Virology 400 128-136; Gonzales A. et al. 1990 J. Virol 64(5):2073-2081 PMCID: PMC249363; Yanez R. et al. 1995. Virology. 1995 Apr. 1; 208(1):249-78; Dixon L K et al. Virus Res. 2013; 173(1):3-14; and Farlow J et al. Virol J. 2018; 15(1):190. Published 2018 December 14.

In aspects, ASFV Ag(s) comprise TCE(s). In aspects, ASFV Ag(s) comprise MHCIE(s) and MHCIIE(s). In aspects, ASFV Ag(s) comprise BCE(s). In aspects, an ASFV Ag CEP lacks any known ASFV BCE(s). In aspects, ASFV MHCIE(s) and MHCIIE(s) in a CEP DOS BC IR(s). In aspects, ASFV Ag(s) are associated with ITS(s), such as PTPS(s), e.g., polyUb(s). In aspects, ASFV Ag CEP(s) comprise PEs in which OSMOA of the PE Ags are ASFV Ags.

In aspects, ASFV Ag(s) comprise Ag(s) from the proline-rich cytoplasmic domain of CD2v; from regions I and II located within the carboxyl-terminal regions of the C-type lectin protein; or both. Examples of such epitopes include SFLNLTKLYHHHSHY (SEQ ID NO:734); KYNLNRKK-SHYTDLL (SEQ ID NO:735), NRKKSHYTDLLFICS (SEQ ID NO:736), SPPPKPCPPPKPCPP (SEQ ID NO:737), and KPCPPPKPCPPPKPC (SEQ ID NO:738) (see, Burmakina et al. J Gen Virol. 2019; 100(2):259-265).

BCE(s) and anti-ASFV Abs that can be incorporated, modified, or ATAOTI include A151R, B438L, and K205R-A104R (Lokhandwala S et al. PLoS One. 2017; 12(5): e0177007). In aspects, an ASFV Ag CEP comprises anti-ASFV Abs or Ab AARSs, e.g., in NGD FPs comprising anti-ASFV Ab AARSs and ASFV Ags.

In aspects, ASFV Ag(s) are from p49, p72, p30, pp62, p56, p54, j18L, CD2v, p22, p12, or combinations. In aspects, OSMOA ASFV Ag(s) of a CEP are from envelope proteins. In aspects, ASFV Ag(s) comprise Ag(s) of 9GL, p72, ASFV C-type lectin, ASFV helicase, ASFV DNA Pol, KP362L, ASFV DNA ligase, ASFV RNA Pol, A104R, EP364R, F317L, or combinations. In aspects, ASFV Ag(s) comprise p30 AARS(s). In aspects, AASF Ag(s) comprise p54 and p30 Ag(s). In aspects, ASFV Ag(s) in a CEP are limited to three types of ASFV Ag(s) or less, such as two types of ASFV Ag(s). In aspects, a CEP lacks ASFV Ag(s) p72, p22, or both. In aspects, ASFV Ag(s) in a CEP comprise A104R, A151R, B119L, B602L, CD2v, K205R, P49 P12, P32, P54, P72, P30/P32, P220, or combinations. In aspects, ASFV Ag(s) of a CEP comprise Ag(s) of CP204L, PK205R, PB602L, CP530R, E183L, PB646L, and combinations. In aspects, an ASFV Ag CEP comprises PE(s) comprising OSMOA ASFV Ags, such as P32-CD2V-I329L-G6L. More exemplary combinations include CP204L+CP530R, PK205R+E183L, PB602L+PB646L, CP204L+PK205R+PB602L, pp220 (P150-P37-P14-P34), and CP204L+PK205R+CP530R. In aspects, ASFV Ag(s) comprise P11 or P11.5 Ags (e.g., PEERCTYKFNSYTKKMEL (SEQ ID NO:739) and DQEEKKALQNKETKNLGIP (SEQ ID NO:740), respectively). Additional ASFV Ag(s) can comprise Ag(s) from pp62/p62, EP153R, NP1450L, NP419L, MGF405-4R, and MGF360-11L. In aspects, ASFV Ag(s) comprise A151R, CP312R, E146L, E184L, MGF110 type protein Ags, and combinations. Additional ASFV Ags, epitopes, and the like that can be incorporated or adapted for use in CEPESCs are described in, e.g., US20080131449; CN110218732; CN110269932; CN110093356; CN109836478; WO202006040; RU2534343; CN110618279; Netherton C L et al. Front Immunol. 2019; 10:1318. doi:10.3389/fimmu.2019.01318; Gaudreault N N, et al. Vaccines (Basel). 2019; 7(2):56. Published 2019 Jun. 25; and Argilaguet J M et al. PLoS One. 2012; 7(9):e40942.

In aspects, an ASFV Ag CEP comprises a sequence that is RVRHRSII to SEQ ID NO:697. In aspects, an ASFV Ag CEP comprises PCRA(s) or CRA(s). Application of ELI to ASFV AARS(s) that can be adapted to testing, identification, or confirmation of CRAs is described in, e.g., Jenson J. et al. PMID: 10986387 and Lacasta A. et al. 2014. Journal of Virology 88(22)13322-13332.

In aspects, OSMGAOA ASFV Ag(s) are AW ITS(s). In aspects OSMOA ITS(s) are PTPS(s), e.g., polyUb(s). In aspects, ASFV Ag(s) are in PE(s) comprising MSL(s), FL(s), MSFL(s), or SCS(s). In aspects, OSMOA ITS(s) are non-PTPS ITS(s), e.g., ERTPS(s) or exosome ITS(s).

In aspects, an ASFV Ag CEP comprises ASFV AgV(s). In an aspect, ASFV AgV(s) comprises consensus sequence Ags (e.g., developed from consensus of ASFV CRA(s), such as immediate, early, or late ASFV CRA(s)). In aspects, ASFV AgV(s) comprise GSRAgV(s). In aspects, an ASFV Ag CEP comprises a sequence related, very related, highly related, substantially identical, or identical (RVRHRSIOI) to ≥1 of SEQ ID NOs:26-28.

In aspects, ASFV Ag(s) comprise EP402R Ag(s), E248R Ag(s), or both, or FV(s) of one or both thereof (e.g., a GSRAgV). Such PPTs are described in, e.g., Karger A, et al. Viruses. 2019; 11(9):864. doi:10.3390/v11090864 & Alonso, C. et al. 2018, J. General Virology, 99: 613-614 (& Uniprot Refs. Q65200, Q6JHU1, & Q89501).

In aspects, CEP(s) comprise EP240R FV(s) comprising GSRV(s) in the potential NLG sites starting at residue 12, residue 55, residue 75, residue 113, residue 143, or combinations, e.g., the leading N residue being replaced by a D residue. In aspects, CEP(s) comprise EP420R FV(s) comprising GSRV(s) in potential NLG sites starting at residue 25, residue 37, residue 52, residue 55, residue 72, residue 77, residue 81, residue 89, residue 95, residue 108, residue 125, residue 137, residue 148, residue 155, residue 151, residue 363, or combinations, e.g., the leading N residue being replaced by a D residue.

In aspects, an ASFV Ag comprises E248R Ag(s) and 402R Ag(s) (which for clarity's sake can be AgV(s) of either/both thereof). In aspects, the EP402R and E248R Ag(s) are separated by linkers (e.g., MSLs, FLs, or MSFLs), SCS(s) (e.g., 2A site(s)), or both. In aspects, OSMOA of the EP402R/E248R Ags are associated with ITS(s), e.g., PTPS(s), e.g., Ub(s) e.g., SEQ ID NO:1.

In aspects, ASFV Ag CEP(s) comprise ITII(s). In aspects, ITII(s) comprise EAT-2 AARS(s). In aspects, AASF Ag CEP(s) comprise NGDCI(s), such as PD-L1 CI(s) or CD112R CI(s). In aspects, OSMOA NGDCI(s) in a CEP lack Ag sequences, are multimeric or both, as in the case of trap proteins. In aspects, ASFV Ag CEP(s) comprise NAN-CIPIs, such as IFNg.

In aspects, ASFV AgES EPESNAM(s) comprise EEI(s), ISNS(s), or both. In aspects, a CEPESC comprises two or more NAMs comprising different EPESs, such as ESs encoding different gDP(s), a gDAgFP and a NGDICRTSFP, a gDAgFP and an ITII, and the like. In aspects, NAM(s) are NAV(s), such as mRNAs or plasmid DNA(s). In aspects, NAV(s) are associated with TFA(s), such as CaPNP(s). In aspects, EPES(s) comprise SCUP(s).

In AOTI, ASFV Ag gDAgFP(s) comprise gDS(s) RHRVRSII to gDS(s) of a human HSV or PRV. In AOTI gDS(s) comprise MgDS(s). In AOTI, CEPs comprise gDSS(s) RVRHRSII to a WT gDSS of an HSV or PRV. In AOTI, OSMOA ASFV Ags in gDAgFP(s) are downstream of any gDS(s) therein. In aspects, gDP(s) of a CEP lack a gDTMD. gDP(s) can lack or comprise gD PFD(s).

In aspects, EPES(s) comprising ASFV AgES(s) comprise NASM(s). In aspects, NASM(s) comprise a FabI gene sequence/triclosan NASM.

In aspects, an ASFV AgES CEPESC comprises another anti-ASFV vaccine or therapeutic. In aspects, an ASFV AgES CEPESC is administered in association with another anti-ASFV vaccine or therapeutic, such as an attenuated ASFV. Examples of such CCC(s) are described in, e.g., Lacasta A. et al. 2015. Vet Res (2015) 46:135 DOI 10.1186/s13567-015-0275-z; U.S. Ser. No. 10/507,237; US20150165018A1; and Pérez-Núñez D et al. Vet Immunol Immunopathol. 2019; 208:34-43.

In aspects, delivery of an EA of an ASFV AgES CEPESC induces anti-ASFV IR(s) in TR(s). In aspects, CEPESC(s) are administered two or more times to TR(s). In aspects, administered CEPESC(s) are identical. In aspects, they are different. In aspects, other compositions are administered in association with CEPESC(s), such as NAMs comprising EPES(s) encoding PIM(s), CI(s), ITII(s), Ag(s), NANCIPI(s), and the like. In aspects, IR(s) comprise DOS increasing the number or activity of one or more IC(s), such as Ag-specific T-cells, BCs, or both; increasing the number or activity of Ag-specific CD4 or CD8 cells; increasing the number or activity of NKCs; increasing the number or activity of TCR-γδ T cells; or a combination thereof. In aspects, IR(s) lead to CE(s), such as DOS reduction in ASFV morbidity or mortality. In aspects, CE(s)/IR(s) comprise DOS reduction in viral shedding, viremia, or CT. In AOTI, CE(s) comprise reduced transmission of ASFV, improved memory response(s) to ASFV(s), or both (e.g., after 6, 9, 12, 18, 24, or 36 months). In AOTI, CE(s) comprise reduction in one or more ASFV symptoms; such as fever; decreased appetite; weakness; diarrhea; vomiting; coughing; skin reddening, blotching or other discoloration (hyperaemia and cyanosis); and respiratory ailments. In aspects, CE(s) include DOS improved economic indicators for swine (see elsewhere here). In aspects, CE(s) include DOS improved live birth rates, improved rate of survival to adulthood in pigs, or both. Aspects can include reduction in ASFV nucleic acids (e.g., by PCR), antibody titers (e.g., by ELISA measurements), etc. in infected TR(s) or upon challenge. ASFV AgES(s) can be delivered as prophylactics (e.g., in sows, piglets, or both) or therapeutics.

6) Equine Herpesvirus

In AOTI, CEPESCs comprising equine herpesvirus (EHV) AgES(s) and gDP(s) are provided. Such CEPs can comprise any suitable number of EHV Ag(s) from any suitable type of EHV and EHV PPT(s). In aspects, EHV Ag(s) comprise EHV-1 Ag(s), EHV-4 Ag(s), or both. In aspects, CEP(s) comprise EHV-1 or EHV-4 Ag(s) that are EHV-1 and EHV-4 cross-protective (inducing DOS IR(s) against both types of EHV(s)). EHV Ag(s) can be of or related to any type/subtype or strain of EHV, e.g., an EHV strain exemplified in U.S. Pat. No. 7,323,178. In aspects, OSMOA of the EHV Ag(s) in a CEP are from genes that have homologs in other alphaherpesviruses (e.g., PRV, HSV, GHV, or BHV). In aspects, OSMOA EHV Ag(s) are from or related to the 5 EHV EPs that lack homologs in other alphaherpes viruses (AHVs). In aspects, OSMOA EHV Ag(s) are structural PPTs (e.g., core proteins, nucleocapsid proteins, virion tegument particle proteins, or CT). In aspects, OSMOA of the EHV Ag(s) are EHV envelope proteins. In aspects, OSMOA of the EHV Ag(s) of a CEP are EHV glycoproteins (e.g., gB (gp14), gC (gp13) gD (gp18), gD, gE, gH, gI, gK, gL, gM, gp21/22a, gp10, or combinations). Such PPTs are KITA (SFE U.S. Pat. No. 6,193,983). In AOTI, CEPs lack any Ag(s) RVRHRSI to gDS(s) of gDP(s), such as gDAgFP(s) of the CEP. In aspects, EHV Ag(s) comprise gH or gC polypeptides (SFE, U.S. Pat. No. 6,083,511). In AOTI, OSMOA of the EHV Ag(s) are of or are related to EHV gB, gC, or gD Ag(s). In aspects, EHV Ag(s) of CEPs comprise an EHV alpha-TIF Ag (ORF12 Ag). EHV PPTs are KITA (SFE, Paillot et al. Open Veterinary Science Journal, 2008, 2, 68-91).

In aspects, OSMOA EHV Ag(s) comprise TCE(s), such as MHCIEs or MHCIIEs. In aspects, EHV Ag CEPs comprise both MHCIEs and MHCIIEs. Examples of EHV T-cell Ags are known in the art and such Ag(s) can be adapted to use in EHV AgES(s) of constructs. SFE Soboll G et al. J Gen Virol. 2003; 84(Pt 10):2625-2634 and Kydd, J. H et al. "The immediate early protein of equine herpesvirus-1 (EHV-1) as a target for cytotoxic T lymphocytes in the Thoroughbred horse" at core.ac.uk.

In aspects, EHV Ag(s) comprise EHV immediate early gene ICP4 (ICP4) epitope(s). In aspects, EHV Ag(s) comprise α-TIF (ETIF; VP16-E) epitope(s) (SFE von Einem et al. Journal of Virology 80 (6) 2609-2620). In aspects, EHV Ag(s) comprise ICP4 and α-TIF TCEs. In aspects, EHV Ag(s) comprise TCE(s) of or that are related to epitopes of α-TIF, ICPO, ICP22, ICP2, or combinations.

In aspects, EHV Ag(s) of CEPs comprise FV(s) in which 1 BCE(s) in WTC(s) are removed. In aspects, EHV Ag(s) lack any known EHV BCEs.

In aspects, EHV Ag(s) of CEPs comprise one or more EHV BCEs. EHV BC Ags and antibodies are known in the art. SFE Ken Maeda et al. Journal of Clinical Microbiology March 2004, 42 (3) 1095-1098; DOI: 10.1128/JCM.42.3.1095-1098.2004 and WO1994016093. Known EHV BC Ags/BCEs can be adapted for incorporation in EHV AgES(s). Anti-EHV Abs and Ab AARS(s) can also be incorporated into EPs, such as NGDFPs.

In aspects, EHV Ag(s) comprise AgV(s). In aspects, OSMOA of EHV Ag(s) are GSRAgV(s). E.g., a GSRV variant of the EHV-1 α-TIF (UniProt P28938) can comprise GSRV(s) at the possible NLG sites starting at residue 49, residue 452, or both, e.g., by replacing N AAs at such positions with D residues.

In aspects, EHV Ag CEPs comprise CRA(s), PCRA(s), or both.

In aspects, EHV Ag CEP comprises Ag-associated ITS(s). In aspects, OSMOA of the ITS(s) are PTPS(s). In aspects, PTPS(s) are polyUb(s).

In aspects, EHV Ag CEP(s) comprise ICSTAP(s) or ITICITM(s). In aspects, ITII(s) comprise EAT-2 PPT(s) or EAT-2 AARS(s). In aspects, ITIIES(S) are in a NAM separate from a gDAgFPESNAM.

In aspects, OSMOA of EHV Ag(s) are in PE(s). In aspects EHV Ag PE(s) comprise MSL(s), FL(s), MSFL(s), cleavage sites, or combinations.

In AOTI, EHV Ag CEP(s) comprise CI(s). In aspects, gDS(s) of the CEP are CI(s). In AOTI, CEPs comprise NGDCI(s). In AOTI, CEPs include both.

In aspects, EHV Ag CEP(s) comprise NCMIMP(s), e.g., cytokine(s).

In aspects, OSMOA of the EHV Ag(s) are contained in gDAgFP(s). In aspects, gDP(s) comprise MgDS(s). In aspects, gDP(s) comprise gDSS(s). In aspects, MgDS(s)

comprise gDS(s) with enhanced nectin-1 protein affinity, reduced HVEM binding, or both.

In aspects, EHV Ag(s) do not comprise EHV gD Ag(s).

In aspects, gDP(s) comprise gDS(s) that are more RVRHRSII to a WT EHV gDS than an HSV gD. In AOTI, gDP(s) comprise WT EHV gDS(s), e.g., a sequence RVRHRSIOI to SEQ ID NO:698. In aspects, a WT EHV gD comprises a TMD, intravirion domain, or both, e.g., SEQ ID NO:699. In aspects, either type of gDP or other gDP comprises a sequence that is RVRHRSII to an EHV gDSS, such as SEQ ID NO:700.

In aspects, EPES NAM(s) comprise EEI(s), SCUP(s), or both. In aspects, OSMOA EPES(s) are contained in NAV(s), such as mRNA(s) or plasmids. In aspects, EPES(s) are in plasmid(s) associated with TFA(s), such as CaPNP(s). In aspects, an EHV AgES CEPES(s) are contained in two or more NAM(s). In aspects, one type of NAM comprises a gDAgFPES and a second type of NAM in the CEPESC comprises NS(s) encoding different gDAgFP(s), Ag(s), PE(s), ITII(s), NGDCI(s), NANCIPI(s), NGDICRT-SAGFP(s) and the like.

In aspects, EHV AgES CEPESC comprise CCC(s), such as EHV vaccines, EHV therapeutics, other immunogenic agents, and the like.

In AOTI, delivering EA of an EHV AgES CEPESC to a TR induces DOS IR(s). In aspects, IR(s) comprise DOS proliferation of IC(s), activation of IC(s), or both. In AOTI, activated or proliferated ICs comprise T-cells, BCs, NKC(s), or CT. In aspects IR(s) comprise DOS cytokine expression from IC(s).

In aspects, delivering EA of an EHV induces DOS CE(s) in TR(s), such as reduction of EHV shedding, reduction of viremia, reduction of abortion, increase in rate of live births, increase in rate of horses reaching adulthood, reduction in respiratory tract disease (e.g., rhinopharyngitis or tracheobronchitis), a reduction in frequency of EHV-associated ocular diseases (e.g., reduction in EHV associated uveitis or chorioretinal lesions); reduction in neurological lesions (e.g., microlesions); reduction in non-suppurative vasculitis; reduction in EHV spread through a population; reduction in frequency or severity of myeloencephalopathy; or combinations thereof. Aspects of EHV conditions are described in, e.g., Allen G P et al. Equid herpesvirus-1 (EHV-1) and -4 (EHV-4) infections. In: Coetzer, J A W and Tustin, R C (Eds.), Infectious diseases of livestock. 2nd Edn. Oxford Press: Cape Town; 2004. pp. 829-859. Chapter 76 and Oladunni F S et al. Front Microbiol. 2019; 10:2668. Published 2019 December 3. doi:10.3389/fmicb.2019.02668.

In aspects, delivering an EA of an EHV AgES CEPESC induces DOS enhanced memory IR(s) against EHV, such as DOS memory T cell response(s).

7) Coronavirus

In aspects, CEPESCs comprising coronavirus (CoV or COV) AgES(s) are provided. CoV Ag CEPs can comprise any suitable number of COV Ag(s) from any suitable type of COV and any suitable type of COV antigens. In aspects, OSMOA of the COV Ag(s) are beta-coronavirus Ag(s), alpha-coronavirus Ag(s), or combinations. In aspects, OSMOA CoV Ag(s) in a CEP are beta-coronavirus Ag(s). In aspects, OSMOA CEP Cov Ag(s) are Embecovirus Ag(s), Hibecovirus Ag(s), Merbecovirus Ag(s), Nobecovirus Ag(s), or Sarbecovirus Ag(s). In aspects, OSMOA CoV Ag(s) are from alpha-COV(s).

In aspects, OSMOA COV Ag(s) of CEPs are from a COV that has been identified of posing a substantial risk of zoonosis. In aspects, OSMOA CEP COV Ag(s) are from a strain of COV that (currently) primarily infects NAH(s). In aspects, OSMOA CEP COV Ag(s) are from a bat COV (e.g., a genus *Betacoronavirus*, subgenus *Sarbecovirus* CoV, e.g., bat-SL-CoVZC45 or bat-SL-CoVZXC21). In aspects, OSMOA COV Ag(s) are Ag(s) from or related to COV(s) that primarily infect 2 or more species.

In aspects, OSMOA COV Ag(s) in CEPs are from or related to a COV known to infect humans (e.g. HCoV 229E, NL63, OC43, or HKU1). In aspects, OSMOA CEP Cov Ag(s) are HCoV alpha-CoV(s) (e.g., 229E or NL63 COV(s)). In aspects, OSMOA CEP Cov Ag(s) are HCov beta-CoV(s) (e.g., OC43 or HKU1).

In aspects, OSMOA CEP COV Ag(s) are of or related to non-SARS human CoVs. In aspects, OSMOA CEP COV Ag(s) are from "common cold" COV strains (e.g., OC43, or 229E).

In aspects, OSMOA CEP COV Ag(s) are from a SARS-associated CoV (SACOV), a MERS-associated CoV (MA-COV) (a.k.a. hCoV-EMC), or combination. In aspects, OSMOA CEP Cov Ag(s) are separately from either SACOV(s) or MERCOV(s). In aspects, OSMOA CoV Ag(s) are Ag(s) from or related to SARS-CoV (identified in 2002, *Betacoronavirus*, subgenus *Sarbecovirus*) (COV1), or SARS-CoV-2 (identified 2019 in Wuhan, China) (COV2).

In aspects, OSMOA CEP COV Ag(s) comprise Ag(s) of or related to a COV spike glycoprotein (S), nucleocapsid (N), envelope (E), or membrane glycoprotein (M). In aspects, COV Ag(s), e.g., SACOV Ag(s), comprise ORF3/ORF3a Ag(s), nsp6 Ag(s), or both, in aspects in combinations with N Ag(s), S Ag(s), or M Ag(s). Examples include combinations of S and M Ag(s), S and nsp6 Ag(s), S and ORF3a Ag(s), S and N Ag(s), or S-M-N Ag(s), S-nsp6-ORF3a Ag(S), and other combinations. In aspects, OSMOA of S Ag(s) are from either the S1 portion of S or the S1 portion of S. Certain β-Cov Ag(s) can include Ag(s) against HE (hemagglutinin-esterase (HE)). In aspects, OSMOA Cov Ag(s) are ORF1ab Ag(s). In aspects, OSMOA of Cov Ag(s) are from a defined receptor binding domain (RBD). In aspects, OSMOA of Cov Ag(s) are structural proteins. In aspects, OSMOA of Cov Ag(s) are non-structural proteins. In aspects, COV Ag(s) comprise a mix of structural and nonstructural Ag(s).

In aspects, a COV Ag comprises most, generally all, or at least substantially all of WT COV PPT(s) (or identified COV PPT domains, such as S1 or S2) or a RVRHRSI FV. A CEP can, e.g., comprise a complete or at least generally complete COV S protein or S domain, such as a SARS COV2 S sequence (e.g., SEQ ID NO: 14 or a HR or SI FV); a complete or at least generally complete SARS COV2 N sequence (e.g., SEQ ID NO: 15 or a HR or SI FV); a complete or at least generally complete COV M protein, such as a SARS COV2 M sequence (e.g., SEQ ID NO: 16 or a HR or SI FV); or combinations.

In aspects, a COV Ag CEP comprises multiple BCEs, multiple TCEs (e.g., multiple MHCIEs and multiple MHCI-IEs), or combinations. In aspects, OSMOA of such multiple Ag(s) are in PE(s). In aspects, PE(s) comprise MSL(s), FL(s), MSFL(s), cleavage sites, or combinations. In aspects, SMOA of the COV Ag(s) in a CEP induce Ag-specific IR(s) in a significant amount of, most of, or at least generally all of TR(s). In aspects, immunodominant epitopes, such as immunodominant TCE(S) are modified, excluded, expressed in lower amounts, etc., to ensure SMOA Ag(s) induce IR(s). Such principles apply to any aspect of the invention, not just COV-related CEPESCs or related methods.

Coronavirus proteins are known in the art. For example, a genome of a SARS-CoV-2 is described in, e.g., Lu R et al. Lancet. 2020; 395(10224):565-574. An example of a source of candidate sequences and virus that can be used in development/testing of constructs (e.g., for the selection of PCRA(s) to be included in a CEP) is provided at NCBI Reference Sequence: NC_045512.2. Additional aspects of SARS-Cov2 biology that can be applied to aspects of the invention re described in Fehr A R et al Methods Mol Biol. 2015; 1282:1-23 and Wu A et al. Cell Host Microbe. 2020; 27(3):325-328.

CoV Ag(s) can comprise TCE(s), BCE(s), or both. In aspects, COV Ag(s) comprise MHCIE(s) & MHCIIE(s). In AOTI, CoV Ag(s) comprise MHCIE(s), MHCIIE(s), & BCE(s). In aspects, COV BCE(s) induce TR neutralizing Ab production in a significant number of TR(s). In AOTI, the presence of COV BCE(s) DOS enhances T-cell IR(s) in TR(s) in Cov infected or challenged TR(s).

In aspects, COV TCE(s) in a CEP PCGCOSCOCO TH 1 T-cell epitopes (TH1TCEs), In aspects of developing Cov CRA(s), PCRA(s) are tested for Th1 cytokine responses to select TH1TCE(s). In methods of inducing CoV IR(s) in TR(s) comprising COV AgES CEPESC(s), OSMOA of the TR(s) are tested for Th2 cytokine levels before or during the method and levels of Th2 cytokines above a standard result in (a) administering a different CEPESC (e.g., a CEPESC that induces a lower Th2 response, a greater Th1 response, or both), (b) changing the dosage frequency, amount, etc., of any further CEPESC administrations, (c) temporarily or permanently stopping any CEPESC method, (d) applying any suitable method for reducing or counteracting the Th2 cytokine level, or (e) combinations. Such composition and method AOTI can be applied to any type of CEPESC or method AOTI (e.g., a CEPESC primarily comprising cancer-related AgES(s) or other pathogen AgES(s)), but such AOTI can be very relevant in certain COV infections, such as where Th2 cytokine levels have been associated with DOS increased levels of COV-associated fatalities or risks thereof).

In aspects, OSMOA CoV Ag(s) in a CEP induce IR(s) that are cross-reactive against multiple types of CoV(s) (e.g., common cold HCOVs and SACOVs; MERSCOV(s) and SARSCOV(s), bat COV(s) and human COV(s), or SARS-COV1(s) and SARSCOV2(s)). Several predictive cross-reactive epitopes are KITA and such knowledge can be adapted to CEPESCs of the invention. Given this fact, CRA methods also can comprise a step of identifying cross-reactive Ag(s) (an aspect that can also apply to other DCA-associated Ag methods—e.g., identifying Ag(s) cross reactive against multiple AHVs).

Specific CoV epitopes have also been experimentally determined or predicted. In aspects, OSMOA of the CoV epitopes are from proven epitopes. In aspects, OSMOA are from predicted epitopes, such as any of the specifically predicted epitopes described in references provided herein. For example, Li C K. J Immunol. 2008; 181(8):5490-5500 describes fifty-five T cell epitopes from 128 SARS-CoV1 patients, which can be incorporated herein. Examples include CoV S Ags RVRHRSIOI to SEQ ID NO:701 & ORF3 COV Ag(s) RVRHRSIOI to SEQ ID NO:702. Another SARS Cov epitope that can be expressed in CEPs is SEQ ID NO:703.

SARS-CoV1 (Sars-Cov) Ag(s) known to be functional epitopes that are in identical PPT(s) in SARS-Cov2 include SEQ ID NOs:704-706. These and numerous similar expected cross-reactive epitopes are described in Ahmed S F et al. Viruses. 2020; 12(3):254. Such Ag(s) can be incorporated as PCRA(s) in CEP(s) or used as SARS-CoV2 PCRA(s).

Additional expected/confirmed SARS-Cov2 TCEs that can be incorporated individually or in combination in CEPs include S protein AARs S405-469, S480-499, and S510-521. In aspects, CEPs also include S370-395 and S435-479, which may comprise both TCEs and BCEs. These and more expected epitopes are described in Zhang et al., 2020, Mapping the Immunodominance Landscape of SARS-CoV-2 Spike Protein for the Design of Vaccines against COVID-19, a copy of which is available at biorxiv.org.

Additional predicted SARS-CoV2 epitopes include ITLCFTLKR, which is characterized in Joshi A et al. Inform Med Unlocked. 2020; 19:100338, the numerous predicted epitopes reported in Kiyotani, K., Toyoshima, Y., Nemoto, K. et al. Bioinformatic prediction of potential T cell epitopes for SARS-Cov-2. J Hum Genet (2020); K. M. Kaderi Kibria, et al. NatureResearch. 2019. DOI: 10.21203/rs.3.rs-21853/v1; Sahoo B et al. International Journal of Applied Biology and Pharmaceutical Technology 11 (2020): 37-45; Bhattacharya, M et al. J Med Virol. 2020; 92: 618-631; and Marek Prachar et al. bioRxiv 2020.03.20.000794 (including AARS(s) common to Cov-MERS/SARS-Cov2 and SARS-CoV1 and SARS-CoV2). Examples of predicted epitopes reported in these references that can be used as PCRA(s) in CEP(s) include SEQ ID NOs:707-715 (and FFs/FVs).

In aspects, OSMOA of COV Ag(s) in a CEP are AgV(s). In aspects, OSMOA AgV(s) comprise GSRV(s) (e.g., CB substitutions or deletions in one, several, or all of the N-X-S sequences or N-X-T AARS motifs present in WTC Ag(s)). In aspects, introducing OOM GSRV(s) is a step in generating PCRA(s). In aspects, OSMOA of COV AgV(s) are editopes. In aspects, OSMOA of COV Ag(s) or a subset thereof, such as BC Ag(s) comprise glycosylation site addition variations. For example, the BCE for SARS-CoV1/CoV2 cross-reactive Ab CR3022 in SARS-Cov2 can be modified to enhance glycosylation sites (e.g., in a manner corresponding to the BCE epitope for CR3022 in SARS-Cov1, adding an NLG site at N protein residue 370), thereby reducing Kd of the Abs for the site to less than 100 nM, ≤50 nM, ≤20 nM, or less than 10 nM. Such an approach is described in Yuan et al. Science 8 May 2020: 630-633. In AOTI, consensus sequence PCRA(s) can be developed from corresponding sequences of various COV(s), from identifying differences in highly related sequences of COV(s) that may be associated with different levels of immunogenicity (as exemplified by the CR3022 epitope example), or both. Several of the references cited in this section also employ such approaches to propose COV TCEs and BCEs.

In an aspect, COV AgV(s) comprise FV(s) having a sequence that is the same as a full length or generally full length COV PPT sequences.

In an aspect, COV AgV(s) include S PPT AgV(s) according to the formula of SEQ ID No:20), where each X is N/D and least one of $X_1$-$X_{22}$ is a D. In aspects, at least 2, ≥3, ≥4, or ≥5 Xs are D AAs. In aspects, most of $X_1$-$X_{22}$ are D residues. In aspects, generally all of $X_1$-$X_{22}$ (e.g., 90%) are D AAs.

In aspects, COV Ag(s) comprise a Cov N PPT AgV(s) according to the formula of SEQ ID NO:21, wherein each of $X_1$-$X_6$ is N/D & ≥1 of $X_1$-$X_6$ is a D. In aspects, at least 2, ≥3, ≥4, at least 5, or all of X1-X6 are D residues.

In aspects, COV Ag(s) comprise a COV M protein AgV comprising at least the N-terminal 10%, 15%, 25%, or 33% of SEQ ID NO:22.

In aspects, COV Ag CEP(s) comprise ITS(s), e.g., PTPS(s), e.g., polyUb(s). In aspects, ITS(s) comprise non-PTPS ITS(s), e.g., ERTPS(s).

In aspects, a COV AgES CEPESC comprises ITIIES(s). In aspects, a CEP comprises ITII(s) comprising EAT-2 PPT(s) or AARS(s) (e.g., hEAT-2, mEAT-2, a FF of either, or a FV). In aspects, ITIIES(s) are on NAM(s) separate from OSMOA of the COV AgES(s) of the CEPESs.

In aspects, a COV Ag CEP comprises CI(s). In aspects, a COV Ag CEP lacks CI(s). In aspects, gDS(s) in the CEP exhibit CI functions in TR(s). In aspects, gD(s) in the CEP do not exhibit CI functions in TR(s). In aspects, the CEP comprises NGDCI(s). In aspects, NGDCI(s) in CEP comprise PD-L1(s), PD-1(s), or CD112R CI(s). In aspects, CEP(s) comprise TOM CI(s). In aspects, CEP(s) comprise gDS CI(s) and NGDCI(s). In aspects, a NGDCI is a multimeric non-Ab sequence CI, such as a trap PPT.

In aspects, a COV Ag CEP comprises NCMIMP(s). In AOTI, NCMIMP(s) comprise Th1 cytokine(s). In AOTI, Th1 cytokines comprise, PC, or consist of IFNg, IL-2, or both, or FFs/FVs thereof.

In aspects, OSMGAOA COV Ag(s) are contained in gDAgFP(s). In aspects, OSMOA COV Ag(s) are positioned downstream of any gDS(s) in gDAgFP(s). In aspects, some COV Ag(s) are positioned internal to gDSs and some COV Ag(s) are positioned downstream of any gDSs of gDAgFP(s).

In aspects, OSMOA of the gDP(s) of a CEP comprise MgDS(s). In aspects, gDAgFP(S) exhibit DOS reduced HVEM binding, exhibit enhanced nectin-1 binding, or both. In aspects, gDP(s) of a CEP comprise gDSS(s).

In aspects, EPESs are contained in 2+ NAM(s). In aspects, 1 NAM comprises gDAgFPES and 1 NAM comprises NS encoding a different gDAgFP(s), COV Ag(s); ICSTAP(s)/ICITM(s); NGDCI(s); NCMIMP(s); or CT.

In aspects, OSMOA of any NAMs of a CEPESC are NAV(s). In aspects, NAV(s) are mRNA NAV(s). In aspects, NAV(s) are plasmids. In aspects, plasmids are associated with TFA(s), such as CaPNP(s).

In aspects, CEPESCs comprise CCC(s), such as anti-COV vaccines, anti-COV therapeutics, or both. In aspects, CEPESC(s) are AAW such agent(s).

In aspects, the delivery of an EA of CEPESC(s) to TR(s) results in DOS anti-COV IR(s). In aspects, IR(s) comprise reduction in viral shedding, reduction in the amount of virus, reduction in the amount of COV nucleic acids, reduction in COV antibodies, or combinations, in TR(s). In aspects, IR(s) comprise DOS increases in population or activity of NKCs, DCs, T-cells (CD4 or CD8), BCs, or combinations. In aspects, IR(s) comprise one or more T-cell IR(s). Aspects of anti-COV T-cell IR(s) are exemplified in, e.g., Li C K, Wu H, Yan H, et al. T cell responses to whole SARS coronavirus in humans. J Immunol. 2008; 181(8):5490-5500. In aspects, IR(s) comprise DOS in immunological memory for COV(s). In aspects, IR(s) comprise DOS increase in memory T-cells. In aspects, IR(s) comprise DOS increases in COV-associated cytokine production. In aspects, increased cytokine production primarily consists of (PCO), generally consists of (GCO), or consists of (CO) PCOGCOCO Th1 cytokine production.

In aspects, anti-COV IR(s) lead to anti-COV CE(s). In aspects, CE(s) comprise DOS reduction in COV-associated fever, cough, dyspnea, diarrhea, or combinations. In aspects, CE(s) comprise DOS reduced frequency, duration, or severity of COV-associated disease or hospitalization, recurrence, or transmission of COV. In aspects, CE(S) comprise reduced fatality rates in a population of TR(s). In aspects, TR(s) comprise elderly human patients (e.g., at least 65, at least 70, at least 75, or at least 80 years of age), patients with comorbidities (e.g., respiratory illness, obesity, diabetes, hyperlipidemia, coronary artery disease, renal disease, dementia, COPD, cancer, atrial fibrillation, heart disease, heat failure, or combinations. In aspects, TR(s) are not fully developed (i.e., children or young NAHs).

In aspects, delivery of COV AgES CEPESCs are repeated TOM times. In aspects, delivery of COV AgES CEPESC(s) is performed in non-infected TR(s) as a prophylactic/vaccination. In aspects, delivery of an EA of COV AgES CEPESC(s) is performed in infected patients as a therapeutic.

a. Bacterial Ags & Epitopes

In aspects, Ag(s) in a CEP comprise bacterial-associated Ag(s). Examples of such aspects include EPs comprising Ag(s) against *Neisseria* spp, including *N. gonorrhea* and *N. meningitidis* (e.g., transferrin-binding proteins, lactoferrin binding proteins, PiC, or adhesins); *S. pyogenes* (for example M proteins or fragments thereof), *S. agalactiae, S. mutans; H. ducreyi; Moraxella* spp, including *M. catarrhalis*, also known as *Branhamella catarrhalis* (for example high and low molecular weight adhesins and invasins); *Bordetella* spp, including *B. pertussis* (for example pertactin, pertussis toxin, filamenteous hemagglutinin, adenylate cyclase, or fimbriae), *B. parapertussis, B. bronchiseptica; Mycobacterium* spp., including *M. tuberculosis* (for example ESAT6, Antigen 85A, -B or -C, MPT 44, MPT59, MPT45, HSP10, HSP65, HSP70, HSP 75, HSP90, PPD 19 kDa [Rv3763], or PPD 38 kDa [Rv0934]), *M. bovis, M. leprae, M. avium, M. paratuberculosis, M. smegmatis; Legionella* spp, including *L. pneumophila; Escherichia* spp, including enterotoxic *E. coli* (e.g., colonization factors, heat-labile toxin or derivatives thereof, heat-stable toxin or derivatives thereof), enterohemorragic *E. coli*, enteropathogenic *E. coli* (for example shiga toxin-like toxin or derivatives thereof); *Vibrio* spp, including *V. cholera* (for example cholera toxin); *Shigella* spp, including *S. sonnei, S. dysenteriae, S. flexnerii; Yersinia* spp, including *Y. enterocolitica* (for example a Yop protein), *Y. pestis, Y. pseudotuberculosis; Campylobacter* spp, including *C. jejuni* (for example toxins, adhesins, and invasins) and *C. coli; Salmonella* spp, including *S. typhi, S. paratyphi, S. choleraesuis, S. enteritidis; Listeria* spp., including *L. monocytogenes; Helicobacter* spp, including *H. pylori* (for example urease, catalase, or vacuolating toxin); *Pseudomonas* spp, including *P. aeruginosa; Staphylococcus* spp., including *S. aureus, S. epidermidis; Enterococcus* spp., including *E. faecalis, E. faecium; Clostridium* spp., including *C. tetani* (for example tetanus toxin), *C. botulinum* (for example botulinum toxin), *C. difficile* (for example *clostridium* toxins A or B); *Bacillus* spp., including *B. anthracis* (for example botulinum toxin); *Corynebacterium* spp., including *C. diphtheriae* (for example diphtheria toxin); *Borrelia* spp., including *B. burgdorferi* (for example OspA, OspC, DbpA, or DbpB), *B. garinii* (for example OspA, OspC, DbpA, or DbpB), *B. afzelii* (for example OspA, OspC, DbpA, or DbpB), *B. andersonii* (for example OspA, OspC, DbpA, or DbpB), *B. hermsii; Ehrlichia* spp., including E. equi and the agent of the Human Granulocytic Ehrlichiosis; *Rickettsia* spp, including *R. rickettsii; Chlamydia* spp., including *C. trachomatis* (for example MOMP or heparin-binding proteins), *C. pneumoniae* (for example MOMP or heparin-binding proteins), *C. psittaci; Leptospira* spp., including *L. interrogans; Treponema* spp., including *T. pallidum* (e.g., rare outer membrane proteins), *T. denticola, T. hyodysenteriae*; or derived from parasites such as *Plas*- modium spp., including *P. falciparum; Toxoplasma* spp., including *T. gondii* (for example SAG2, SAG3, or Tg34); *Entamoeba* spp., including *E. histolytica; Babesia* spp., including *B. microti; Trypanosoma* spp., including *T. cruzi; Giardia* spp., including *G. lamblia; Leshmania* spp., including *L. major; Pneumocystis* spp., including *P. carinii; Trichomonas* spp., including *T. vaginalis; Schisostoma* spp., including *S. mansoni*, or derived from yeast such as *Candida* spp., including *C. albicans; Cryptococcus* spp., including *C. neoformans*. Antigens against *M. tuberculosis* include Rv2557, Rv2558, RPFs: Rv0837c, Rv1884c, Rv2389c, Rv2450, Rv1009, aceA (Rv0467), PstS1, (Rv0932), SodA (Rv3846), Rv2031c 16 kDa1, Tb Ra12, Tb H9, Tb Ra35, Tb38-1, Erd 14, DPV, MTI, MSL, mTTC2 and hTCC1 (WO 99/51748) and fusions thereof, e.g., Ra12-TbH9-Ra35, Erd14-DPV-MTI, DPV-MTI-MSL, Erd14-DPV-MTI-MSL-mTCC2, Erd14-DPV-MTI-MSL, DPV-MTI-MSL-mTCC2, TbH9-DPV-MTI (WO 99/51748). Ags against *Chlamydia* include for example the High Molecular Weight Protein (HWMP) (WO 99/17741), ORF3 (EP 366 412), and putative membrane proteins (Pmps), as well as others described in WO 99/28475. Ags against *Streptococcus* spp, including *S. pneumoniae*, include PsaA, PspA, streptolysin, and choline-binding proteins, and the protein antigen Pneumolysin (Biochem Biophys Acta, 1989, 67, 1007; Rubins et al., Microbial Pathogenesis, 25, 337-342), and mutant detoxified derivatives thereof (WO 90/06951; WO 99/03884). Other preferred bacterial vaccines comprise antigens derived from *Haemophilus* spp., including *H. influenzae* type B (for example PRP and conjugates thereof), non-typeable *H. influenzae*, for example OMP26, high molecular weight adhesins, P5, P6, protein D and lipoprotein D, and fimbrin and fimbrin derived peptides (U.S. Pat. No. 5,843,464) or multiple copy variants or fusion proteins thereof. Ag(s) can be Ag(s) of or related to bacteria of any suitable phyla, such as Acidobacteria, Actinobacteria, Aquificae, Bacteroidetes, Caldiserica, Chlamydiae, Chlorobi, Chloroflexi, Chrysiogenetes, Cyanobacteria, Deferribacteres, Deinococcus-Thermus, Dictyoglomi, Elusimicrobia, Fibrobacteres, Firmicutes, Fusobacteria, Gemmatimonadetes, Lentisphaerae, Nitrospira, Planctomycetes, Proteobacteria, Spirochaetes, Synergistetes, Tenericutes, Thermodesulfobacteria, Thermotogae, and Verrucomicrobia.

Bacterial Ag(s) can be against Gram positive bacteria, Gram negative bacteria, acid-fast bacteria, or combinations. Gram positive bacteria include Actinomedurae, *Actinomyces israelii, Bacillus anthracis, Bacillus cereus, Clostridium botulinum, Clostridium difficile, Clostridium perfringens, Clostridium tetani, Corynebacterium, Enterococcus faecalis, Listeria monocytogenes, Nocardia, Propionibacterium acnes, Staphylococcus aureus, Staphylococcus epiderm, Streptococcus mutans, Streptococcus pneumoniae* and the like. Gram negative bacteria include *Afipia felis, Bacteroides, Bartonella bacilliformis, Bortadella pertussis, Borrelia burgdorferi, Borrelia recurrentis, Brucella, Calymmatobacterium granulomatis, Campylobacter, Escherichia coli, Francisella tularensis, Gardnerella vaginalis, Haemophilius aegyptius, Haemophilius ducreyi, Haemophilius influenziae, Heliobacter pylori, Legionella pneumophila, Leptospira interrogans, Neisseria meningitidia, Porphyromonas gingivalis, Providencia sturti, Pseudomonas aeruginosa, Salmonella enteridis, Salmonella typhi, Serratia marcescens, Shigella boydii, Streptobacillus moniliformis, Streptococcus pyogenes, Treponema pallidum, Vibrio cholerae, Yersinia enterocolitica, Yersinia pestis* and the like. As used herein, acid-fast bacteria include, but are not limited to, *Myobacterium avium, Myobacterium leprae*, and *Myobacterium tuberculosis*. Other bacteria include *Bartonella henseiae, Chlamydia psittaci, Chlamydia trachomatis, Coxiella burnetii, Mycoplasma pneumoniae, Rickettsia akari, Rickettsia burnezekii, Rickettsia rickettsii, Rickettsia tsutsugamushi, Rickettsia typhi, Ureaplasma urealyticum, Diplococcus pneumoniae, Ehrlichia chafensis, Enterococcus faecium*, Meningococci and the like.

Ag(s) can be associated with abaerobic bacterium or an anerobic bacterium and Ag(s) can be associated with autotrophic bacterium or a heterotrophic bacterium. Ag(s) can be associated with a mesophile, a neutrophile, an extremophile, an acidophile, an alkaliphile, a thermophile, a psychrophile, a halophile, or an osmophile.

In aspects, Ag(s) of CEPs induce IR(s) against bacterial pathogens. Bacterial pathogens include, but are not limited to, *Acinetobacter baumannii, Bacillus anthracis, Bacillus subtilis, Bordetella pertussis, Borrelia burgdorferi, Brucella abortus, Brucella canis, Brucella melitensis, Brucella suis, Campylobacter jejuni, Chlamydia pneumoniae, Chlamydia trachomatis, Chlamydophila psittaci, Clostridium botulinum, Clostridium difficile, Clostridium perfringens, Clostridium tetani*, coagulase Negative *Staphylococcus, Corynebacterium diphtheria, Enterococcus faecalis, Enterococcus faecium, Escherichia coli*, enterotoxigenic *Escherichia coli* (ETEC), enteropathogenic *E. coli, E. coli* O157:H7, *Enterobacter* sp., *Francisella tularensis, Haemophilus influenzae, Helicobacter pylori, Klebsiella pneumoniae, Legionella pneumophila, Leptospira interrogans, Listeria monocytogenes, Moraxella catarralis, Mycobacterium leprae, Mycobacterium tuberculosis, Mycoplasma pneumoniae, Neisseria gonorrhoeae, Neisseria meningitides, Preteus mirabilis, Proteus* sps., *Pseudomonas aeruginosa, Rickettsia rickettsii, Salmonella typhi, Salmonella typhimurium, Serratia marcesens, Shigella flexneri, Shigella sonnei, Staphylococcus aureus, Staphylococcus epidermidis, Staphylococcus saprophyticus, Streptococcus agalactiae, Streptococcus mutans, Streptococcus pneumoniae, Streptococcus pyogenes, Treponema pallidum, Vibrio cholerae*, and *Yersinia pestis*. Bacterial pathogens may also include bacteria that cause resistant bacterial infections, for example, clindamycin-resistant *Clostridium difficile*, fluoroquinolon-resistant *Clostridium difficile*, methicillin-resistant *Staphylococcus aureus* (MRSA), multidrug-resistant *Enterococcus faecalis*, multidrug-resistant *Enterococcus faecium*, multidrug-resistance *Pseudomonas aeruginosa*, multidrug-resistant *Acinetobacter baumannii*, and vancomycin-resistant *Staphylococcus aureus* (VRSA). In aspects, Ag(s) of a CEP induce IR(s) against an infectious bacteria, such as *Mycobacterium tuberculosis*, clindamycin-resistant *Clostridium difficile*, fluoroquinolon-resistant *Clostridium difficile*, methicillin-resistant *Staphylococcus aureus* (MRSA), multidrug-resistant *Enterococcus faecalis*, multidrug-resistant *Enterococcus faecium*, multidrug-resistance *Pseudomonas aeruginosa*, multidrug-resistant *Acinetobacter baumannii*, & vancomycin-resistant *S. aureus* (VRSA).

In aspects, bacterial Ag(s) in CEPs comprise Ag(s) of or related to PPT(s) of *S. pyogenes, Neisseria gonorrhoeae, Acinetobacter baumannii, Klebsiella pneumoniae, Pseudomonas aeruginosa, Burkholderia cepacia*, or CT.

Bacterial Ag(s) can be Ag(s) of or related to *Salmonella, Escherichia, Pseudomonas, Bacillus, Vibrio, Campylobacter, Heliobacter, Erwinia, Borrelia, Pelobacter, Clostridium, Serratia, Xanothomonas, Yersinia, Burkholdia, Listeria, Shigella, Pasteurella, Enterobacter, Corynebacterium*, or *Streptococcus*. Bacterial Ag(s) can be Ag(s) of or related to an anthrax bacterium, an antibiotic-resistant bacterium, a disease-causing bacterium, a food poisoning bacterium, an infectious bacterium, *Staphylococcus* bacterium, *Streptococcus* bacterium, or tetanus bacterium. Bacterial Ag(S) can be Ag(s) against mycobacteria, *Clostridium tetani, Yersinia pestis, Bacillus* anthraces, methicillin-resistant *S. aureus* (MRSA), *Clostridium difficile*, or *M. tuberculosis*.

In aspects, Ag(s) in CEP(s) comprise *Mycobacterium tuberculosis* antigen(s) (e.g., Ag(s) from the Ag85 family of TB Ags, for example, Ag85A and Ag85B; the Esx family of TB antigens, for example, EsxA, EsxB, EsxC, EsxD, EsxE, EsxF, EsxH, EsxO, EsxQ, EsxR, EsxS, EsxT, EsxU, EsxV, & EsxW; or CT).

In aspects, CEPs comprise Ag(s) against bacteria that primarily infect NAH(s) (e.g., companion animals, such as dogs, horses, or cats; livestock animals, such as pigs, cows, and sheep; or both). In aspects, CEPs comprise bacterial Ag(s) from bacteria that primarily infect humans. In aspects, CEPs comprise bacterial Ag(s) from bacteria that infect both humans and NHA(s) or that are considered at risk for zoonosis.

In aspects, CEPs comprise bacterial Ag(s) that are T-cell Ag(s), B-cell Ag(s), or both. In aspects, CEPs comprise anti-bacterial MHCIE(S), MHCIIE(s), or both. CEP(s) can comprise bacterial PPT PCRA(s), CRA(s), known bacterial Ag(S)/epitope(s), or combinations. Numerous epitopes for bacterial diseases are known in the art, including AgV(s). For example, known and variant *M. tuberculosis* TCEs that can be adapted for or incorporated into CEP(s) are described in Coscolla M et al. Cell Host Microbe. 2015; 18(5):538-548. *S. aureus* TCE(s) that can be used in CEPs are described in, e.g., Yang S et al. Microb Pathog. 2020; 144:104167; Ooi J D et al. Nat Commun. 2019; 10(1):3392; and Yu S et al. Microb Pathog. 2015; 89:108-113. Epitopes and identification of TCEs in *Pseudomonas aeruginosa* is exemplified in, e.g., Parmely M J et al. J Exp Med. 1984; 160(5):1338-1349 and Worgall S, Krause A, Rivara M, et al. Protection against *P. aeruginosa* with an adenovirus vector containing an OprF epitope in the capsid. J Clin Invest. 2005; 115(5):1281-1289 and related epitope prediction methods are described in Elhag et al. bioRxiv 720730; *Clostridium difficile* epitopes/Ags are described in, e.g., Broecker F et al. Nat Commun. 2016; 7:11224 and Seregin S S, et al. Vaccine. 2012; 30(8):1492-1501.

In aspects, OSMOA of bacterial Ag(s) in CEPs are AgV(s) (e.g., editope(s)). In aspects, OSMOA AgV(s) comprise GSRV(s), other DIV(s), or CT.

In aspects, CEP(s) comprise bacterial PPT PCRA(s), CRA(s), or both.

In aspects, CEP(s) comprise multiple bacterial Ag(s). In aspects, multiple bacterial Ag(s) are from the same species, type, or strain of bacteria. In aspects, multiple Ag(s) are from different species, types, or strains of bacteria. In aspects, OSMOA of the bacterial Ag(s) are in PE(s). In aspects, PE(s) comprise MSL(s), FL(s), MSFL(s), cleavage sites (e.g., 2A sites), or combinations, in association with OSMOA of the Ag(s) in PE(s). In aspects, OSMOA bacterial Ag(s) in a CEP are in gDAgFP(s).

In aspects, OSMOA bacterial Ag(s) in CEPs are AW ITS(s), such as PTPS(s). In aspects, OSMOA bacterial Ag(s) are associated with polyUb(s).

In aspects, a bacterial Ag CEP comprises ITII(s). In aspects, ITII(s) comprise EAT-2 PPT(s) or EAT-2 AARS(S) (e.g., EAT-2 FPs). In aspects, ITII(s) comprise hEAT-2, mEAT-2, FFs of either thereof, or FV of any thereof.

In aspects, a bacterial Ag CEP comprises CI(s). In aspects, gDS(s) act as CI(s) in TR(s). In aspects, a CEP comprises NGDCI(s). In aspects, a CEP comprises NGDCI(s) and gDS(s) that are CI(s) in TR(s). In aspects, NGDCI(s) comprise PD-L1 or CD112R CI(s). In aspects, CI(s) comprise multimeric non-Ab AAR Cis, such as trap proteins.

In aspects, a bacterial Ag CEP comprises NANCIPI(s), e.g., cytokine(s). In aspects, most or all NANCIPI(s) are Th1 cytokines.

In aspects, a bacterial Ag CEP comprises a gDAgFP comprising MgDS(s). In aspects, bacterial Ag CEP(s) comprise multiple gDP(s). In aspects, bacterial Ag CEPs comprise multiple bacterial Ag gDAgFPs. In aspects, OSMOA gDP(s) in such a CEP comprise gDSS(s). In aspects, bacterial Ag CEPs comprise NGDICRTSFPs comprising bacterial Ag(s).

In aspects, bacterial AgES CEPESCs include EEI(s), ISNS(s), or CT.

In aspects, a bacterial AgES CEPESC comprises multiple NAMs. In aspects, a first NAM encodes a gDAgFP and a second NAM encodes a different gDP, bacterial Ag(s) (e.g., PE(s)), NGDICRTSFP(s), ITII(s), CI(s) (e.g., NGDCI(s)), NANCIPI(s), or combinations.

In aspects, OSMOA of the NAM(s) of a bacterial AgES CEPESC are NAV(s), such as mRNA(s) or plasmid(s). In aspects, plasmid(s) are associated with TFA(s), such as CaPNP(s).

In aspects, bacterial AgES CEPESC(s) are combined with CCC(s), such as antibiotics, NAM(s) encoding anti-bacterial compositions, anti-bacterial peptides, etc. In aspects, methods of delivering such CEPESC(s) comprise administering one or more anti-bacterial agents (vaccines, antibiotics or other anti-bacterial therapeutics, etc.) to TR(s).

In aspects, delivery of EA(s) of bacterial AgES CEPESC(s) induce anti-bacterial IR(s) in TR(s). In aspects, IR(s) include reduction in bacterial Abs, bacterial NS(s) (e.g., as determined by qPCR), or both. In aspects, IR(s) comprise increase in the number or activity of IC(s), such as anti-bacterial T-cells, BCs, NKCs, APCs, and the like. In aspects, IR(s) lead to CE(s) such as the treatment of disorders, diseases, or conditions associated with bacterial infection including DOS reduction in abscesses, actinomycosis, acute prostatitis, *Aeromonas hydrophila*, annual ryegrass toxicity, anthrax, bacillary peliosis, bacteremia, bacterial gastroenteritis, bacterial meningitis, bacterial pneumonia, bacterial vaginosis, bacterium-related cutaneous conditions, bartonellosis, BCG-oma, botryomycosis, botulism, Brazilian purpuric fever, Brodie abscess, brucellosis, Buruli ulcer, campylobacteriosis, caries, Carrions disease, cat scratch disease, cellulitis, chlamydia infection, cholera, chronic bacterial prostatitis, chronic recurrent multifocal osteomyelitis, clostridial necrotizing enteritis, combined periodontic-endodontic lesions, contagious bovine pleuropneumonia, diphtheria, diphtheritic stomatitis, ehrlichiosis, erysipelas, piglottitis, erysipelas, Fitz-Hugh-Curtis syndrome, flea-borne spotted fever, foot rot (infectious pododermatitis), Garre's sclerosing osteomyelitis, Gonorrhea, Granuloma inguinale, human granulocytic anaplasmosis, human monocytotropic ehrlichiosis, hundred days' cough, impetigo, late congenital syphilitic oculopathy, legionellosis, Lemierre's syndrome, leprosy (Hansen's Disease), leptospirosis, listeriosis, Lyme disease, lymphadenitis, melioidosis, meningococcal disease, meningococcal septicaemia, methicillin-resistant *Staphylococcus aureus* (MRSA) infection, *Mycobacterium avium-intracellulare* (MAI), *mycoplasma* pneumonia, necrotizing fasciitis, nocardiosis, noma (cancrum oris or gangrenous stomatitis), omphalitis, orbital cellulitis, osteomyelitis, overwhelming post-splenectomy infection (OPSI), ovine brucellosis, pasteurellosis, periorbital cellulitis, pertussis (whooping cough), plague, pneumococcal pneumonia, Pott disease, proctitis, *pseudomonas* infection, psittacosis, pyaemia, pyomyositis, Q fever, relapsing fever (typhinia), rheumatic fever, Rocky Mountain spotted fever (RMSF), rickettsiosis, *salmonellosis*, scarlet fever, sepsis, *serratia* infection, shigellosis, southern tick-associated rash illness, staphylococcal scalded skin syndrome, streptococcal pharyngitis, swimming pool granuloma, swine brucellosis, syphilis, syphilitic aortitis, tetanus, toxic shock syndrome (TSS), trachoma, trench fever, tropical ulcer, tuberculosis, tularemia, typhoid fever, typhus, urogenital tuberculosis, urinary tract infections, vancomycin-resistant *Staphylococcus aureus* infection, Waterhouse-Friderichsen syndrome, *pseudotuberculosis* (*Yersinia*) disease, yersiniosis, and combinations. In aspects, delivery of bacterial AgES CEPESCs results in a DOS enhanced IR, CE, or both (e.g., improved memory IR(s)) WRT existing anti-bacterial vaccines, such as peptide anti-bacterial vaccines.

b. NVNBO Ags & Eptiopes

In aspects, an EP comprises Ag(s) against a non-viral, non-bacterial pathogenic organism (NVNBO), which in some aspects are microorganisms (NVNBMs). In aspects, NVNBOs comprise parasitic DCA(s) (parasite(s)). A parasite against which such Ag(s) can be directed can be, e.g., a protozoa, helminth, or ectoparasite. A helminth (i.e., worm) can be a flatworm (e.g., flukes and tapeworms), a thorny-headed worm, or a round worm (e.g., pinworms). Ectoparasites include e.g., lice, fleas, ticks, and mites. Pathogenic protozoans and helminths infections against which Ag(s) can be directed include: amebiasis; malaria; leishmaniasis; trypanosomiasis; toxoplasmosis; *Pneumocystis carinii*; babesiosis; giardiasis; trichinosis; filariasis; schistosomiasis; nematodes; trematodes or flukes; and cestode (tapeworm) infections. In aspects, parasite Ag(s) are associated with OOM of *Acanthamoeba keratitis*, Amoebiasis, Ascariasis, Babesiosis, Balantidiasis, Baylisascariasis, Chagas disease, Clonorchiasis, *Cochliomyia*, Cryptosporidiosis, Diphyllobothriasis, Dracunculiasis, Echinococcosis, Elephantiasis, Enterobiasis, Fascioliasis, Fasciolopsiasis, Filariasis, Giardiasis, Gnathostomiasis, Hymenolepiasis, Isosporiasis, Katayama fever, Leishmaniasis, Lyme disease, Malaria, Metagonimiasis, Myiasis, Onchocerciasis, Pediculosis, Scabies, Schistosomiasis, Sleeping sickness, Strongyloidiasis, Taeniasis, Toxocariasis, Toxoplasmosis, Trichinosis, and Trichuriasis. In aspects, parasite Ag(s) are associated with one or more of *Acanthamoeba, Anisakis, Ascaris lumbricoides*, Botfly, *Balantidium coli*, Bedbug, Cestoda (tapeworm), Chiggers, *Cochliomyia hominivorax, Entamoeba histolytica, Fasciola hepatica, Giardia lamblia*, Hookworm, *Leishmania, Linguatula serrata*, Liver fluke, *Loa loa, Paragonimus*-lung fluke, Pinworm, *Plasmodium falciparum, Schistosoma, Strongyloides stercoralis*, Mite, Tapeworm, *Toxoplasma gondii, Trypanosoma*, Whipworm, or *Wuchereria bancrofti*. In aspects, Ag(s) comprise parasite antigen(s) of or related to PPT(s) expressed in *Babesia, Entomoeba, Leishmania, Plasmodium, Trypanosoma, Toxoplasma*, Giarda, flat worms and round worms.

In AOTI, CEP(s) comprise Ag(s) of/related to Ag(s) of protozoa, e.g., *Entamoeba histolytica, Giardia lambila, Trichomonas vaginalis, Trypanosoma brucei, T. cruzi, L. donovani, Balantidium coli, Toxoplasma gondii, Plasmodium* spp., & *Babesia microti*. In AOTI, CEP(s) include Ag(s) of/related to parasites, e.g., *Acanthamoeba, Anisakis, Ascaris lumbricoides*, botfly, *Balantidium coli*, bedbug, Cestoda, chiggers, *Cochliomyia hominivorax, Entamoeba histolytica, Fasciola hepatica, Giardia lamblia*, hookworm, *Leishmania, Linguatula serrata*, liver fluke, *Loa loa, Paragonimus*, pinworm, *P. falciparum, Schistosoma, Strongyloides stercoralis*, mite, tapeworm, *Toxoplasma gondii, Trypanosoma*, whipworm, & *Wuchereria bancrofti*.

In aspects, CEP(s) comprise Ag(s) against a species of the genus *Leishmania*. In aspects, *Leishmania* Ag(s) comprise AARS(s) of or related to PPT(s) of an *L. donovani* complex *Leishmania* (e.g., an *L. donovani* or *L. infantum* (*L. chagasi*) PPT); an *L. mexicana* complex *Leishmania* (e.g., a *L. mexicana, L. amazonensis*, or *L. venezuelensis* PPT); *L. tropica; L. major; L. aethiopica*; or a member of the subgenus *Viannia* (e.g., a PPT of *L. braziliensis, L. guyanensis, L. panamensis*, or *L. peruviana*). In aspects, *Leishmania* Ag(s) are cross-protective against TOM *Leishmania* species, types, or strains.

In aspects, *Leishmania* Ag(s) comprise AARS(s) of or related to antigenic *Leishmania* PPTs such as gp63, H1, NH36, LACK, *Leishmania* PSA, *Leishmania* H2B, LmIRAB, P0, KMP-11, A2, HSP, HSC, LmSTI-1, CPa, CPb. HASP, LPG, CPc, elongation factor-2 (eIF-2), enolase, aldolase, triose phosphate isomerase (TPI), protein disulfide isomerase (PDI), or p45. In aspects, *Leishmania* Ag(s) comprise AARS(s) from or that are related to AARS(s) of *Leishmania* LACK, NH36, KMP-11, gP63, LmIRAB, H2B, CPa, or Cpb PPTs or combinations. Such PPTs are described in, e.g., Sundar S, et al. Expert Rev Vaccines. 2014; 13(4): 489-505. Known and predicted Ags and epitopes against *Leishmania* species are known in the art and described in E Silva R F et al. Front Immunol. 2020; 10:3145. Published 2020 Feb. 14; Zhang J et al. PLoS One. 2020; 15(3): e0230381. Published 2020 Mar. 16; Palatnik-de-Sousa C B. Front Immunol. 2019; 10:813; Hamrouni S et al. PLoS Negl Trop Dis. 2020; 14(3):e0008093; jaya Kumar et al., Front. Immunol., 2017; Das et al., Science Translational Medicine, 2014: 234RA56; Kashyap M et al. Infect Genet Evol. 2017; 53:107-115; Alves-Silva M V et al. Front Immunol. 2017; 8:100. In aspects, OSMOA of the *Leishmania* epitope(s) are THIEs. Examples of such epitopes are known in the art (SFE Joshi S et al. Front Immunol. 2019; 10:288). Such Ag(s)/epitopes can be adapted for AgES(s) or can be modified to form AgV(s), PE(s), and the like, or associated with ITS(s), such as polyUb(s), or both. In aspects, CEPESCs comprise PCRA(s) or CRA(s) related to NVNBOs, such as *Leishmania*. Examples of bioinformatics epitopes that can be used in such approaches are described in Bordbar A et al. Infect Genet Evol. 2020; 80:104189.

In aspects, delivery of EA(s) of *Leishmania* AgES CEPESCs result in anti-*Leishmania* IR(s). In aspects, such IR(s) include DOS increases in the production of IL-12, IFN-γ, or both. In aspects, IR(s) comprise an increase in the number or activity of IC(s), such as *Leishmania* Ag-specific T-cells, B cells, or both. In aspects, IR(s) comprise increased anti-*Leishmania* innate immune cell or innate trained immune cell activity (e.g., enhanced macrophage activity). In aspects, IR(s) include enhanced anti-*Leishmania* memory immune responses, such as an increase in the number of memory T cells specific for *Leishmania* Ag(s) (e.g., DOS increases in *Leishmania* Ag-specific CD4+ and CD8+ central memory T cells). In aspects, IR(s) lead to DOS CE(s) such as reduction in lesions, reduction in visceral disease, reduction in *Leishmania*-related fatalities, and reduction of *Leishmania*-related symptoms, such as weight loss, enlarged spleen or liver, prolonged fever, and the like.

In AOTI, CEPs comprise Ag(s) against malaria-associated DCA Ags, e.g., *Plasmodia falciparum* PPTs, such as RTS, S, and TRAP (SFE WO9310152). Other plasmodia Ags that can be in CEPs include *P. faciparum* MSP1, AMA1, MSP3, EBA, GLURP, RAP1, RAP2, Sequestrin, PfEMP1, Pf332, LSA1, LSA3, STARP, SALSA, PfEXP1, Pfs25, Pfs28, PFS27/25, Pfs16, Pfs48/45, or Pfs230 PPTs/AARSs and their analogues in *Plasmodium* spp. The *Plasmodium falciparum* Ag can include the circumsporozoite (CS) antigen. In aspects, Ag(s) can include *P. falciparum* PPTs CS, LSA1, TRAP, CelTOS (Ag2), and Ama1. In AOTI, Ag(s) comprise CSP PPT(s) or FF/FV thereof. Such PPTs are described in U.S. Pat. No. 8,470,560. In AOTI, Ag(s) comprise highly conserved AARS(s). In AOTI, Ag(s) are cross-reactive against 2+ strains or species of pathogen.

In aspects, delivery of an adverse event (AE) of CEPESC(s) DOS induces IR(s), CE(s), or both against NVNBO(s) in TR(s). In aspects, such methods treat or treat the symptoms of diseases such as amoebiasis, giardiasis, trichomoniasis, African Sleeping Sickness, American Sleeping Sickness, leishmaniasis (Kala-Azar), balantidiasis, toxoplasmosis, malaria, *Acanthamoeba keratitis*, and babesiosis. In aspects, such methods treat diseases or conditions associated with parasitic infections, e.g., *Acanthamoeba keratitis*, amoebiasis, ascariasis, babesiosis, balantidiasis, baylisascariasis, chagas disease, clonorchiasis, *cochliomyia*, cryptosporidiosis, diphyllobothriasis, dracunculiasis, echinococcosis, elephantiasis, enterobiasis, fascioliasis, fasciolopsiasis, filariasis, giardiasis, gnathostomiasis, hymenolepiasis, isosporiasis, katayama fever, leishmaniasis, lyme disease, malaria, metagonimiasis, myiasis, onchocerciasis, pediculosis, scabies, schistosomiasis, sleeping sickness, strongyloidiasis, taeniasis, toxocariasis, toxoplasmosis, trichinosis, and trichuriasis.

In aspects, a CEP comprises fungi-associated Ag(s) (fungal Ag(s)). In aspects, a CEP comprises Ag(s) associated with or related to PPTs of a fungi of an *Aspergillus* species, *Blastomyces dermatitides*, *Candida* yeasts (e.g., *Candida albicans*), *Coccidioides*, *Cryptococcus neoformans*, *Cryptococcus gattii*, dermatophyte, *Fusarium* species, *Histoplasma capsulatum*, Mucoromycotina, *Pneumocystis jirovecii*, *Sporothrix schenckii*, *Exserohilum*, or *Cladosporium*. In aspects, CEP(s) comprise Ag(s) that are of or related to PPT(s)/AARS(s) expressed in *Aspergillus, Coccidoides, Cryptococcus, Coccidioides immitis, Candida Nocardia, Candida albican, Pneumocystis*, and *Chlamydia*. In aspects, Ag(s) comprise AARS(s) of or related to PPT(s) expressed in Ascomycota (e.g., *Fusarium oxysporum, Pneumocystis jirovecii, Aspergillus* spp., *Coccidioides immitis/posadasii, Candida albicans*), Basidiomycota (e.g., *Filobasidiella neoformans, Trichosporon*), Microsporidia (e.g., *Encephalitozoon cuniculi, Enterocytozoon bieneusi*), and Mucoromycotina (e.g., *Mucor circinelloides, Rhizopus oryzae, Lichtheimia corymbifera*). In aspects, CEPs comprise Ag(s) associated with dermatophytic fungi or keratinophilic fungi.

In aspects, TCE(s) in such CEPs CPCGCOSCOCO TH17Es.

In aspects, CEPESCs comprising fungal Ag(s) induce anti-fungal IRs, such as DOS increase in the number/activity of anti-fungal-specific T-cells or BCs or DOS proliferation or activity enhancement in ITICs, such as DCs, NKCs, or CT. In aspects, such IR(s) result in CE(s), such as DOS reduction in fungal spores, or DOS reduction in the cause or conditions of associated fungal infections, such as aspergilloses, blastomycosis, candidasis, coccidioidomycosis, cryptococcosis, histoplasmosis, mycetomas, paracoccidioidomycosis, and tinea pedis. Anti-fungal CEPESCs can comprise any components of CEPESCs described herein, such as ITII(s), CI(s) (including NGDCI(s)), NANCIPI(s) and the like. ES(s) can comprise EEI(s) and can be in TFA-associated NAVs.

ii. Cancer Ags & Epitopes

In a further aspect, CEPESCs comprising cancer AgES(s) are provided. Numerous aspects of cancer are described here and the methods-related portions of this Detailed Description, infra. In general, any of the aspects, principles, and methods described in either section or in any other related section of this disclosure can be applied to the practice of the invention (e.g., incorporated in CEPESC methods or compositions).

Cancer AgES CEPESCs can comprise any suitable number of cancer AgES(s) from any suitable type of cancer(s). Terms such as "cancer" are understood in the art and, accordingly, described herein only in a non-limiting and illustrative manner. In general, cancer refers to a disease condition in which abnormal cells divide without control. The term tumor typically is used to describe detectable collections of cancer cells. Other aspects of cancers are discussed elsewhere in this disclosure and in the art.

Historically, cancers were named for/classified by the organ or type of cell in which they tended to initiate. E.g., cancer that begins in the colon is traditionally called "colon cancer" and cancer that begins in melanocytes of the skin is called melanoma. Such classifications were made previously with little or no consideration of molecular pathology or immunobiology of the particular described tumor or cancer. Accordingly, there has been increasing scrutiny into the historical organ-of-origin/cell-of-origin classification of cancers and efforts to improve on such classification, including the WHO Classification of Tumours and the Cancer Genome Atlas project (SFE Li Y et al. BMC Genomics. 2017; 18(1):508. Published 2017 Jul. 3). Recently, it has been demonstrated that cell-of-origin typically remains one of, if not the most, dominant indicator of cancer typing considering a number of molecular factors (e.g., DNA-methylation-based clustering) (SFE Hoadley K A et al. Cell. 2018; 173(2):291-304.e6). Accordingly, traditional cancer classifications continue to be valid. Moreover, such classifications continue to be widely used in the art. Accordingly, both types of classifications are used in this disclosure. Any classification based on organ-of-origin or cell-of-origin will generally apply to any subclassification of cancers identified in association with such cancers. Such generalizations may be determined to only apply to some subtypes of such cancers as may be later determined through experimentation or findings (e.g., bladder cancer is associated with several different subtypes of cancer based on molecular classifications). One finding of such new approaches is actually that many cancers of different organ-of-origin and cell-of-origin type share similar molecular and other characteristics. Accordingly, application of methods/Ag(s) to a particular type of cancer described herein can be also be applied to cancers having similar molecular properties, immunological properties, or both, as a cancer identified by organ-of-origin or cell-of-origin.

In aspects, cancer Ag(s) (or "cAg(s)") in CEPs are from or related to C1-LUAD-enriched cancer cell PPTs; C2-Squamous-like cancer cell PPTs; C3-BRCA/Luminal cancer cell PPTs; C4-BRCA/Basal cancer cell PPTs; C5-KIRC cancer cell PPTs; C6-UCEC cancer cell PPTs; C7-COAD/READ cancer cell PPTs; C8-BLCA cancer cell PPTs; C9-OV cancer cell PPTs; C10-GBM cancer cell PPTs; or C13-AML cancer PPTs; or combinations. The relevant molecular characterization of such cells is described in, e.g., Hoadley K A et al. Cell. 2014; 158(4):929-944.

In aspects, cAg(s) in CEPs are from cancer cells immunologically classified as type C1 (wound healing) cancer cells (e.g., occurring frequently in colorectal cancer, lung squamous cell carcinomas, breast carcinoma, head and neck carcinoma and chromosomally unstable gastrointestinal cancer); type C2 (IFN-γ dominant) cancer cells (associated frequently with gastric, ovarian (OV), HNSC, and cervical tumors (CESC)); type C3 (Inflammatory) cancer cells, associated frequently with kidney, prostate, and pancreatic cancers, and papillary thyroid carcinomas; type C4 (Lymphocyte Depleted) cancer cells (associated with adrenocortical carcinoma (ACC), pheochromocytoma and paraganglioma (PCPG), hepatocellular carcinoma (LIHC), and gliomas) type C5 (Immunologically Quiet) cancer cells frequently associated with lower grade gliomas (LGGs); type C6 (TGF-β Dominant) cancer cells; and CT. Such immunological classification is described in Thorsson V et al. 2019 20; 51(2):411-412 & Immunity. 2018; 48(4):812-830.e14.

In aspects, cAg(s) are associated (are from/related to and induce IR(s) against) carcinoma cells/cancers (e.g., adenocarcinoma, basal cell carcinoma, squamous cell carcinoma, and transitional cell carcinoma). In aspects, cAg(s) are associated with sarcoma cells/cancers. In aspects, cAg(s) are associated with leukemia (e.g., lymphoblastic leukemia). In aspects, cAg(s) are associated with a myelodysplastic syndrome cancer (e.g., acute myeloid leukemia (AML)). In aspects CAg(s) are associated with choriocarcinoma, chronic lymphocytic leukemia (CLL), chronic myeloid leukemia (CML), Hodgkin lymphoma, myeloma, melanoma, mesothelioma, non-Hodgkin lymphoma (NHL), soft tissue sarcoma or other sarcoma (e.g., an angiosarcoma or chondrosarcoma), glioblastoma, neuroblastoma, glioma, blastoma, gestational trophoblastic tumour (GTT), blastic plasmacytoid dendritic cell neoplasm, acral lentiginous melanoma, actinic keratoses, acute lymphocytic leukemia, adenoid cystic carcinoma, adenomas, anorectum cancer, astrocytic tumor, bartholin gland carcinoma, bronchial gland carcinoma, carcinoid, cholangiocarcinoma, chondosarcoma, choriod plexus papilloma/carcinoma, chronic lymphocytic leukemia, clear cell carcinoma, cystadenoma, endodermal sinus tumor, endometrial hyperplasia, endometrial stromal sarcoma, endometrioid adenocarcinoma, endothelial cell cancer, ependymal cancer, epithelial cell cancer, Ewing's sarcoma, eye and orbit cancer, female genital cancer, focal nodular hyperplasia, gastric antrum cancer, gastric fundus cancer, gastrinoma, glioblastoma, glucagonoma, hemangiblastomas, hemangioendothelioma, hemangiomas, hepatic adenoma, hepatic adenomatosis, hepatobiliary cancer, hepatocellular carcinoma, insulinoma, intaepithelial neoplasia, interepithelial squamous cell neoplasia, intrahepatic bile duct cancer, jejunum cancer, Kaposi's sarcoma, leiomyosarcoma, lentigo maligna melanomas, lymphoma, male genital cancer, malignant melanoma, malignant mesothelial tumors, medulloblastoma, medulloepithelioma, meningeal cancer, mesothelial cancer, metastatic carcinoma, mucoepidermoid carcinoma, multiple myeloma, neuroepithelial adenocarcinoma nodular melanoma, non-epithelial skin cancer, non-Hodgkin's lymphoma, oat cell carcinoma, oligodendroglial cancer, osteosarcoma, papillary serous adenocarcinoma, plasmacytoma, pseudosarcoma, pulmonary blastoma, renal cell carcinoma, retinoblastoma, rhabdomyosarcoma, sarcoma, small cell carcinoma, serous carcinoma, somatostatin-secreting tumor, submesothelial cancer, superficial spreading melanoma, T cell leukemia, verrucous carcinoma, VIPoma, uterine cervix cancer, uterine corpus cancer, uveal melanoma, Wilms tumor, or hairy cell leukemia.

In aspects, cAg(s) are associated with cells of anal cancer (including anal canal cancer), bile duct cancer, bilary tract cancer, bladder cancer, bone cancer, bone marrow cancer, bowel cancer, brain tumor, breast cancer, cervical cancer, CNS cancer, colon cancer, connective tissue cancer, colorectal cancer, colon cancer, endometrial cancer, eye cancer, digestive system cancer, duodenum cancer, endocrine system cancer, gallbladder cancer, gastric cancer, glial cancer, head and neck cancer, heart cancer, ileum cancer, joint cancer, kidney cancer, large intestine cancer, laryngeal cancer, liver cancer, lung cancer (e.g., small-cell lung cancer or non-small cell lung cancer), mouth or oropharyngeal cancer, muscle cancer, nasal and sinus cancers, nasopharyngeal cancer, nasal tract cancer, esophageal cancer, ovarian cancer, pancreatic cancer, parotid cancer, penile cancer, pituitary cancer, prostate cancer, pharynx cancer, renal cancer, rectal cancer, respiratory system cancer, salivary gland cancer, skin cancer (e.g., non-melanoma skin cancer), sinus cancer, small intestine cancer, stomach cancer, testicular cancer, tongue cancer, thyroid cancer, uterine cancer, urehtra cancer, ureter cancer, vaginal cancer, vulval cancer, cancer of the peritoneum, hepatocellular cancer, gastric or stomach cancer (including gastrointestinal cancer), cervical cancer, ovarian cancer, liver cancer, bladder cancer, hepatoma, breast cancer, colon cancer, colorectal cancer, endometrial or uterine carcinoma, salivary gland carcinoma, kidney cancer (e.g., renal cell carcinoma), liver cancer, prostate cancer, vulval cancer, thyroid cancer, hepatic carcinoma, anal carcinoma, penile carcinoma, melanoma, and various types of head and neck cancer.

cAg(s) can be AW non-Hodgkin's lymphoma, e.g., B-cell lymphoma(s) or T-cell lymphoma(s), e.g., diffuse large B-cell lymphoma, mediastinal B-cell lymphoma, follicular lymphoma, small lymphocytic lymphoma, mantle cell lymphoma, marginal zone B-cell lymphoma, extranodal marginal zone B-cell lymphoma, nodal marginal zone B-cell lymphoma, splenic marginal zone B-cell lymphoma, Burkitt lymphoma, lymphoplasmacytic lymphoma, hairy cell leukemia, CNS lymphoma, precursor T-lymphoblastic lymphoma, peripheral T-cell lymphoma, cutaneous T-cell lymphoma, angioimmunoblastic T-cell lymphoma, extranodal natural killer/T-cell lymphoma, enteropathy type T-cell lymphoma, subcutaneous panniculitis-like T-cell lymphoma, anaplastic large cell lymphoma, or peripheral TC lymphoma).

In AOTI, cAg(s) are AW PPT(s) from cancer cells CB the expression of cancer cell marker(s). In AOTI, such cancer cell marker(s) include CD123: CD2, CD19, CD20, CD30, CD38, CD40, CD52, CD70, EGFR/ERBB1, IGF1R, HER3/ERBB3, HER4/ERBB4, MUC1, TROP2, cMET, SLAMF7, PSCA, MICA, MICB, TRAILR1, TRAILR2, MAGE-A3, B7.1, B7.2, CTLA4, and PD1.

In AOTI, the FP lacks the K9Melapoly P E. In aspects, the FP lacks any canine melanoma Ags, any canine TAA(s), or any melanoma Ags.

In aspects, cAg(s) are associated with solid tumor cancer cells. In aspects, cAg(s) are associated with non-solid-tumor cancer cells (e.g., a blood cancer, non-tumor-forming breast cancer, or liquid tumor cancer).

a. Cancer Antigen/Epitope Types

In aspects, cAgs comprise TCE(s). In aspects, TCE(s) comprise MHCIE(S), MHCIIE(s), or both. In aspects, TCE(s) comprise both MCHIE(s) and MHCIIE(s). In aspects, TCE(s) comprise more than 3 TCE(s). In aspects, OSMOA of the TCE AARS(s) in the CEP are at least 15 AAs, at least 18 AAs, or at least 20 AAs in length. In aspects, OSMOA shorter TCE(s) are associated with upstream or downstream flanking sequences. In aspects, SMOA TCE(s)

are TH1 TE(s). In aspects, one or some (OOS) TCE(s) are T17 TE(s). In aspects, OSMOA cAg(s) comprise BCE(s). In aspects, CEPs lack DCA-associated BCE(s).

cAg(s) can comprise any suitable number of cancer Ag(s) classified into any one or more (OOM) suitable cancer Ag classification(s). In aspects, cAg(s) comprise AARS(s) of or related to PPT(s) over expressed in cancer cells, expressed in association with cancer-causing DCA(s), or both. In aspects, OSMOA cAg(s) in a CEP comprise tumor-associated antigen(s) (TAA(s)). In aspects, OSMOA cAg(s) comprise cancer testis Ag(s)-CTA(s)/cancer germline Ag(s)-CGA(s)) (e.g., MAGE-A1, NY-ESO-1, and SSX-2 Ag(s)). In aspects, OSMOA cAg(s) in a CEP comprise viral cancer-associated Ag(s) (VCAA(s)). In aspects, OSMOA cAg(s) in a CEP comprise tumor-specific Ag(s) (TSA(s) or Ag(s) classified as neoantigen(s) (NA(s)) (or Ag(s) classifiable as either). In aspects, OSMOA cAg(s) in a CEP are oncoprotein Ag(s). In aspects, cAg(s) comprise a mixture of two or more of such Ag types (e.g., 3 or more such Ag types). In aspects, cAg(s) comprise OOM TAA(s) and OOM TSA(s)/NA(s). In aspects, OSMOA TSA(s)/NA(s) in a CEP are shared (public) NA(s) (SNA(s)).

In aspects, OSMOA cAg(s) of a CEP are related to differentiation antigens (e.g., Gp100, Melan-A/Mart-1, and Tyrosinase). In aspects, OSMOA cAg(s) in a CEP are oncofetal Ag(s) (e.g., carcinoembryonic antigen (CEA)). In aspects, OSMOA cAg(s) are antiapoptotic proteins (e.g., livin and survivin), hTERT, or a tumor suppressor protein (e.g., p53). In aspects, OSMOA cAg(s) of a CEP are mimotopes of tumor-associated carbohydrate antigens (TACAs). In aspects, cAg(s) comprise CTs of these or other cAg(s) DEH.

In AOTI, OSMOA cAg(s) of a CEP are xenogenetic Ag(s), comprising sequences CPCGCOSCO or CO an AARS of or associated with homolog of OOM of the CAg(s) described here in a TR (e.g., an CAg comprising an AARS of a CAg from a NHA cancer that is a human homolog of a human cancer CEA, MAGE, or Tyrosinase). In AOTI, OSMOA CAg(s) are hybrid/chimeric xenogenetic Ag FPs comprising both TR-endogenous CAg-related AARS(s) and xenogenetic (other species) AARS(s) from related homolog(s). In aspects, such a CAg(s) exhibits DOS IR(s) (e.g., MHCII Ag presentation) than the corresponding human or non-FP counterpart cAg (in the same context). The use of xenogenetic Ag(s) is not limited to cancer, however, and can be applied to any type of CEP described in this disclosure (e.g., viral AgES CEPESCs).

In aspects, a CEP comprises synthetic epitope(s) in combination with CAg(s). In one exemplary aspect, the synthetic epitope is the pan DR epitope (PADRE). This aspect can be applied to other types of CEPESCs described in this disclosure (e.g., viral Ag CEP(s)).

In aspects, CAg(s) comprise a mix of immunodominant & unconventional epitopes. In aspects, such a mix is delivered by associated but separate administration of CEPESCs or CEPESC(s) and other AgES NAM compositions (e.g., a 2nd composition comprising a NGDICRTS-Ag FP, such as a DEC-205-binding domain/Ag FP). In AOTI, most, generally all, substantially all, or all of the CAg(s) in a CEP exhibit a DOS in a significant number of TR(s). In aspects, such CEP(s) comprise a collection of CAg(s) selected for control of immunodominance, comprise CAgV(s) modified for reduced immunodominance, or both. In AOTI, CAg(s) comprise unnatural immunity epitope(s).

In aspects, CAg CEPs comprise PE(s). In aspects, PE(s) comprise FL(s), MSL(s), MSFL(s), SCSs, or CT. In aspects, gDFPAg(s) comprise PE(s).

In aspects, OSMOA CAg(s) of a CEP are associated with ITS(s), e.g., PTPS(s), e.g., polyUb(s). In aspects, CAg(s) are AW non-PTPS ITS(s).

In aspects, OSMOA CAg(s) comprise antigen recognition/presentation facilitating sequences (ARPFS(s)). In aspects ARPFS(s) comprise HSP(s), MHC(s), or both. In aspects, CAg CEPs comprise OOM ES(s) coding for anti-cancer PPT(s) or AARS(s), such as anti-angiogenic factor(s), e.g., anti-VEGF PPT(s). In aspects, CAg CEP(s) comprise anti-cancer Ab PPTs (e.g., Ab FPs or other Ab PPTs). In aspects, CEPs lack Ab AARS(s).

CAg(s) are KITA. Relevant teachings concerning such antigens and other compositions, methods, techniques, and principles relevant to and can be adapted to combine/incorporate in these aspects of the invention are described in, e.g., Luo W et al. Cancer Cell Int. 2020; 20:66. Published 2020 Mar. 4; Curran M A et al. Annu Rev Med. 2019; 70:409-424; Maeng H M et al. F1000Res. 2019; 8:F1000 Faculty Rev-654. Published 2019 May 13; Pender A et al. Cancers (Basel). 2018; 11(1):1. Published 2018 Dec. 20; Lee S H et al. Hum Vaccin Immunother. 2015; 11(8):1889-1900; Buonaguro L, et al., Clinical and Vaccine Immunology January 2011, 18 (1) 23-34; Lopes, A et al. J Exp Clin Cancer Res 38, 146 (2019); New Strategies to Improve Therapeutic Vaccines (Seyyed Shamsadin Athari Ed.) (2018) (e.g., the chapter by Yu, C. et al.); Pan R Y et al. J Immunol Res. 2018; 2018:4325874. Published 2018 Dec. 19; Terbuch A et al. Vaccines (Basel). 2018; 6(3):52. Published 2018 Aug. 9; Yamamoto, T. N., et al. Nat Med 25, 1488-1499 (2019); and Hollingsworth R E et al. NPJ Vaccines. 2019; 4:7.

Examples of CAg(s) KITA suitable for expression in CEP(s) include Her2/Neu CAgs; abnormally expressed PPT CAgs (e.g., MAGE-A3, BAGE, AFP, XAGE-1B, mesothelin, PRAME, or Muc-1); melanoma-associated CAgs (e.g., Mart-1, GP-100, tyrosinase-related protein 1, tyrosinase-related protein 2, etc.); prostate cancer-associated CAgs (e.g., PSA, PAP, and PSMA); & B cell leukemia/lymphoma-associated CAgs (Ig gamma or Ig kappa). CAg(s) can fall within both these & other classifications (e.g., tyrosinase is a melanoma-associated CAg and survivin and NY-ESO are abnormally expressed PPTs).

To further illustrate these aspects, types of CAg(s) are described briefly in further detail in a non-limiting manner in the following sections. It will be clear from such description that these CAg(s) can be combined in any suitable manner in CEPs and that there can be overlap in the various classifications that follow or precede this paragraph.

1) Viral Cancer Antigens

In aspects, OSMOA CAg(s) of a CEP are VCAA(s). VCAAs typically arise from oncogenic viral PPTs, and, accordingly, also can be classified as oncoproteins (other oncoproteins are discussed below). Readers will recognize that there also can be overlap between viral pathogen Ag(s) and VCAA(s) (i.e., in one aspect a CEP comprises OOM Ag(s) that can be classified both as anti-viral Ag(s) and VCAA(s), as in the case of HPV Ag(s)). In aspects, a VCAAgES CEPESC induces DOS IR(s) against an oncogenic virus. In aspects, delivery of an EA of a VCAAgES CEPESC induces DOS reduction in viral neoplasia(s).

Well-studied VCAAs include the HPV E6/E7 PPTs. In aspects, CEP(s) comprise one or both type of Ag(s). In aspects, OSMOA CAg(s) in a CEP are HPV16 VCAA(s), HPV18 VCAA(s), or a combination (E6, E7, or other Ag(s)). In aspects, HPV AgES CEPESCs can be characterized in that (a) HPV Ag(s) in the CEP are associated with PTPS(s); gDSS, mGDS(s), AgV(s) (e.g., GSRV Ag(s), such as a GSRV EP7, e.g. SEQ ID NO:716 or a FF/FV); (b) the CEP comprises or is delivered in association with ITII(s) (e.g., hEAT-2 or a FF or FV); (c) are expressed from NAV(s) (e.g., mRNA(s) or CaPNP-associated plasmid(s)); are expressed from multiple NAM(s); (d) comprise HPV Ag PE(s) comprising MSL(s), FL(s), or MSFL(s), self-cleavage site(s), or combinations; or (e) comprise a combination of two or more of any aspect of (a)-(d). In aspects, HPV AgES CEPESC(s) comprise OOM aspects of at least three of (a)-(d). In aspects, HPV AgES CEPESCC(s) comprise OOM aspects of all four of (a)-(d). In aspects, an HPV Ag CEP comprises capsid protein L2 Ag(s). In aspects, OOM of such HPV AgES CEPESCs exhibit DOS improved IR(s) as compared to gDAgFP(s) comprising HPV Ag(s) described in the Wistar Art. In aspects, the improved IR comprises enhanced memory immunity effect(s). In aspects, delivering an EA of OOM of such HPV AgES CEPESC(s) results in DOS reduction in HPV associated cervical carcinomas; HPV-positive head and neck cancers; or both. In aspects, TR(s) treated with such HPV AgES CEPESC(s) have not been exposed to HPV. In aspects, TR(s) have been diagnosed with a premalignant HPV-associated disease such as cervical intraepithelial neoplasia (CIN) or vulvar intraepithelial neoplasia (VIN) and the delivery of an EA of the CEPESC DOS reduces progression of such conditions to cancer. In aspects, delivery of EA(s) HPV AgES CEPESC(s) induces DOS reductions in HPV-associated cervical intraepithelial neoplasia (CIN), cervical cancer, or head and neck cancer in HPV challenged TR(s) or HPV-infected TR(s).

In aspects, CEPs comprise Merkel cell carcinoma virus (MCCV) (Merkel Cell Polyoma virus) Ag(s). In an aspect, CAg(s) comprise MCCV large T Ag(s), small T Ag(s), or combinations. In AOTI, EA(s) of such CEPESC(s) DOS induces CE(s) against or treats/prevents Merkel cell carcinoma(s) in TR(s).

In aspects, CEPs comprise human T lymphotropic virus-1 (HTLV-1) Ag(s). In aspects, a CEP comprises HTLV-1 tax PPT Ag(s). In aspects, delivery of EA(s) of related CEPESC(s) induce CE(s) against or treats or prevents HTLV-1-associated neoplastic transformation, spastic paresis induction, or both.

In aspects, a CEP comprises EBV Ag(s). In aspects, a CEP comprises EBV EBNA-1, EBV LMP2, or a combination thereof. In aspects, delivery of an EA of such CEPESC(s) DOS treats or prevents EBV-associated nasopharyngeal carcinoma, Burkitt's lymphoma, or both.

In aspects, a CEP comprises CVM Ag(s). In aspects, a CEP comprises polyomavirus Ag(s) (e.g., middle T (mT) oncoprotein Ag(s)).

In AOTI, CEPs comprise human herpesvirus 8 (HHV-8) (KSV) Ag(s). In aspects, delivery of EA(s) of an HHV-8 AgES CEPESC(s) prevents or treats Kaposi's sarcoma (KS) or a HHV-8-associated lymphoproliferative disorder (e.g., primary effusion lymphoma and multicentric Castleman's disease).

In aspects, an anti-cancer CEPESC comprises HBV Ag(s), HCV Ag(s), or both. In aspects, TR(s) receiving such CEPESCs are pre-cancerous or have not been exposed to the indicated DCA and the delivery of an EA of CEPESC(s) DOS reduces the inflammatory tissue environment in virus-infected TR(s) or TR(s) subsequently challenged with such viruses.

2) TAAs and CGAs

In aspects, CEPs comprise TAA(s)/CGA(s). TAA/CGA CEP(s) can include any suitable number and type of TAA/ CGA. In aspects, OSMOA CAg(s) of a CEP are differentiation TAA(s) (e.g., PSA, mammaglobin-A, or tyrosinase). In aspects, OSMOA CAg(s) of a CEP are overexpression Cag(s) (e.g., HER2 and TERT). In aspects, OSMOA CAg(s) of a cEP are CGA(s) (e.g., MAGE or BAGE). In aspects, OSMOA CAg(s) of a CEP are oncofetal CAg(s) (e.g., CEA or TPBG). In aspects, CAg(s) of a CEP comprise 2, 3, or 4 of such Ag types.

Several TAAs are known and can be incorporated into CEPs (including examples provided above). Well-studied TAAs include CEA, MAGE Ags (e.g., MAGE-A Ags), and MUC Ags. In aspects, such Ag(s) are incorporated in CEP(s) or FFs or FVs thereof are incorporated into CEPs.

In aspects, a CEP comprises MAGE CAg(s) (e.g., MAGE-1, MAGE-3, MAGE-4, MAGE-12, or other MAGE Ag(s) (see e.g., WO99/40188).

In aspects, a CEP comprises prostate cancer CAg(s). Examples of such CAg(s) include prostate specific antigen (PSA), PAP, PSCA (PNAS 95(4) 1735-1740 1998), PSMA; Prostase (Prostase Ag(s) are described in, e.g., P. Nelson et al. Proc. Natl. Acad. Sci. USA (1999) 96, 3114-3119; Ferguson, et al. (Proc. Natl. Acad. Sci. USA 1999, 96, 3114-3119; WO 98/12302; WO 98/20117; and WO 00/04149); P501S (SEQ ID NO:113 of WO98/37814); PS108 (WO 98/50567); STEAP (PNAS 96 14523 14528 7-12 1999); and Ag(s) described in WO98/37418 and WO/004149. Additional prostate CAg(s) and related PMCs ATAOTI are described in Zahm C D et al. Pharmacol Ther. 2017; 174:27-42; Michael A, et al. Expert Rev Vaccines. 2013; 12(3):253-262; & Laccetti Curr Opin Urol. 2017; 27(6):566-571.

In other aspects, a CEP comprises AARS(s) of or related to Plu-1 Ag(s) (J Biol. Chem 274 (22) 15633-15645, 1999), HASH-1 Ag(s), HasH-2 Ag(s), Cripto Ag(s) (Salomon et al Bioessays 199, 21 61-70, U.S. Pat. No. 5,654,140) Criptin Ag(s) (e.g., U.S. Pat. No. 5,981,215), tyrosinase, and survivin. In aspects, CEP(s) comprise CAg(s) of or related to Muc-1, Muc-2, EPCAM, her 2/Neu, Wilms tumor-1 (WT-1/WT1), mammaglobin (U.S. Pat. No. 5,668,267) or those disclosed in WO/00 52165, WO99/33869, WO99/19479, WO 98/45328. Additional CAg(s) of which sequences or related sequences can be incorporated in CEPs include MART, trp, gp100, MUM-1-B (melanoma ubiquitous mutated gene product), HER-2, Ras, PSA BCR-ABL, CASP, CDK, p53, TWI, PAP, telomerase, EGFR, LMP-1, PSMA, PSA, PSCA, tyrosinase, TRP, gp100, SSX-2, CD19, or CD20. ERG, Androgen receptor (AR) antigen, PAK6 antigen, a Prostate Stem Cell Antigen (PSCA), Stratum Corneum Chymotryptic Enzyme (SCCE) antigen, human telomerase reverse transcriptase (hTERT) antigen, a Proteinase 3 antigen, a Tyrosinase Related Protein 2 (TRP2) antigen, a High Molecular Weight Melanoma Associated Antigen (HMW-MAA), a synovial sarcoma antigen, a X (SSX)-2 antigen, an interleukin-13 Receptor alpha (IL13-R alpha) antigen, a Carbonic anhydrase IX (CAIX) antigen, a p97 melanoma antigen, a KLH antigen, a HSP-70 antigen, a beta-HCG antigen, or a Testisin antigen. In aspects, a CEP comprises PRAME, BAGE, Lage (also known as NY Eos 1) SAGE and HAGE (WO 99/53061) or GAGE (Robbins and Kawakami, 1996, Current Opinions in Immunology 8, pps 628-636; Van den Eynde et al., International Journal of Clinical & Laboratory Research (1997); Correale et al. (1997), Journal of the National Cancer Institute 89, p 293. These and other antigens that can be incorporated or adapted for use in CEP(s) are described in US20190290686, US20190032064, and US20180094071.

In AOTI, CEP(s) comprise NY-ESO-1 Ag(s) & delivering EA(s) of CEPESC(s) induce DOS IR(s) WRT bladder cancer(s) or treats/prevents BC.

In aspects, CEPs comprise HER2 Ag(s) & delivering EA(s) of such CEPESC(s) induce DOS IR(s) against breast cancer(s) or treats/prevents it.

In aspects, a CEP comprises CEA Ag(s) and delivering EA(s) of the related CEPESC(s) induce DOS IR(s) against colorectal cancer(s) or treats it.

In aspects, a CEP comprises WT1 Ag(s) and delivering EA(s) of the related CEPESC(s) induce DOS IR(s) against leukemia, or treats or prevents it.

In aspects, a CEP comprises MART-1, gp100, or tyrosinase Ag(s), or combinations, and delivering EA(s) of the related CEPESC(s) induce DOS IR(s) against colorectal cancer(s) or treats or prevents such cancers.

In aspects, a CEP comprises pregulated lung cancer (URLC10) epitope peptide Ag and an EA of the related CEPESC induces DOS IR(s) against non-small cell lung cancer(s).

In aspects, a CEP comprises surviving Ag(s) and an EA of CEPESC induces anti-ovarian cancer IR(s) or treats or prevents ovarian cancer.

In AOTI, CEPs comprise a MUC1 CA(g) & delivering EA(s) of such CEPESC(s) induces DOS IR(s) against pancreatic cancer(s) or treats or prevents the disease.

In aspects, a CEP comprises a MUC2 CA(g) and delivering an EA of the related CEPESC induces DOS IR(s) against prostate cancer or treats or prevents the disease. In aspects such a CEP further comprises additional prostate cancer Cag(s), e.g., PSA Ag(s).

In AOTI, CEP(s) with Ag(s) that PCGCOSCO or CO TAA Ag(s) are associated with 1 CI or 2+CI(s) (e.g., a NGDCI, such as PD-L1 CI, CD112R CI, CRACC CI, or FAP CI, and a gDS CI), or three CI(s). In aspects, a primarily TAA CEP comprises ITII(s) (e.g., hEAT-2 or a FF or FV). In AOTI, a primarily TAA CEP comprises one or two Cis and ITII(s). In aspects, OSMOA TAA Ag(s) of a CEP are AgV(s). In AOTI, OSMOA TAA AgV(s) are FPs comprising 1+ AARSs that enhance recognition of TAA(s) (e.g., a HSP, viral Ag, bacterial Ag, or synthetic epitope). In AOTI, TAA AgV(s) include AARS(s) of TAA homolog(s).

3) Mutational Ags (TSAs and Neoantigens/Neoepitopes)

In aspects, CAg(s) of CEPs comprise mutational Ag(s) (a.k.a., mutanome-derived antigens). Mutational Ag(s) are mutated "self-antigens," typically arising from non-synonymous mutations.

In aspects, OSMOA of the mutational CAg(s) in a CEP are classifiable as tumor specific antigens (TSAs). Typically, non-synonymous mutations generate CAg(s) that are more "specific" in being associated with certain cells, populations, and carcinogenesis processes. Importantly, TSAs are not expressed on normal cells and thus typically do not induce autoimmunity and typically are subject of less tolerance than TAAs (TAAs in contrast often are PPTs that are overexpressed in cancer cells, but also expressed in low levels in normal cells). TSAs are described in, e.g., Hollingsworth R E, et al. NPJ Vaccines. 2019; 4:7. In aspects, TSA(s) are related to PPTs involved in cancer development (e.g., oncogenes and tumor suppressor genes, such as Ras and Bcr-Abl (such CAg(s) are further discussed below). In aspects, an anti-cancer CEP which PCGCOSCO of CO TSA(s) exhibits DOS reduced autoimmunity effects, detectably reduced tolerance, or both than a comparable product PCGCOSCO TAA(s). The "specificity" of TSA(s) is a relative term, however, as such mutations can occur in several tumors/cancers and sometimes even in normal cells. In aspects, TSAs of a CEP occur in less than about 65%, less than about 50%, or less than about 45% of a population.

In aspects, OSMOA of the CAg(s) in a CEP are classifiable as neoantigens. Neoantigens are a class of TSAs that similarly arise from mutations which are more common in cancer cells. Neoantigens are highly individual-specific and usually do not involve known oncogenes. Given their individual and highly specific nature neoantigens can often be DOS more effective in inducing anti-cancer IR(s) than TAAs. In an aspect, a neoantigen is present in less than about 2%, less than about 1.5%, less than about 1% of a population, or less than 0.5% of a population; are recognized by less than about 1%, less than about 0.5%, or less than about 0.25% of the T cells in TR(s); or both (before treatment).

An intermediate class of TSAs are "shared neoantigens" (SNAs) (sometimes also called "public neoantigens") (SFE Zhao W. et al. Pharmacogenomics. Published Online:19 May 2020). In an aspect, OSMOA of the CAg(s) in a CEP are classifiable as shared neoantigens. In aspects, shared neoantigens are present in between about 1-30%, 1.5-30%, 2-30%, 1-25%, 1.5-25%, 2-25%, 1-20%, 1.5-20%, or about 2-20% of a population; are recognized by 55%, 52.5%, or less than 1% of T-cells in TR(s) or both (before treatment).

Examples of known SNA epitopes include KQMNDARHG (SEQ ID NO:741) associated with breast cancer cells, LSKITEQEK (SEQ ID NO:742), and STRDPLSKI (SEQ ID NO:743). These and other SNA(s) are described in Wood, M. A et al. BMC Cancer 18, 414 (2018). Other examples of neoantigens/SNA(s) include BRAF V600E (Liu Q et al. Cancer Immunol. Immunother. 2018; 67:299-310) and KRAS G12D (Chaft J. E. Clin. Lung Cancer. 2014; 15:405-410). Additional neoantigens are the frameshift peptide (FSP) neoantigens available through Creative Biolabs (Shirley, N.Y., USA—creative-biolabs.com/vaccine). Mutineoantigen PEs have been described by D'Alise, A. M et al. Nat Commun 10, 2688 (2019). Shared neoantigens are also described in Christopher A. J Exp Med 2 Jan. 2018; 215 (1): 5-7. Numerous additional tumor-specific neoepitopes are defined in WO2016187508 (see Tables 1-9). Any of these TSA(s) can be incorporated into CEP(s) individually, in combination, or in combination with other CAg(s).

In aspects, OSMOA TSA(s) of a CEP (e.g., SNA(s) or neoantigen(s) of a CEP) are associated with a "driver gene" PPT(s) (i.e., a PPT necessary for tumor survival). Examples of such genes associated with neoantigens/SNA(s) include PIK3CA, FAT4, BRCA2, GNAQ, LRP1B, and PREX2 (SFE Zhou J et al. Biomed Res Int. 2019; 2019:8103142. Published 2019 Jun. 13. In aspects, OSMOA of the CAg(s) of a CEP comprise such driver gene-associated neoantigens/SNA(s).

In aspects, OSMOA neoantigen(s)/SNA(s) of a CEP are already present in TR(s). In aspects, OSMOA neoantigen(s)/SNA(s) of a CEP are not present in TR(s). In AOTI, a CEP comprises a mix of neoantigen(s)/SNA(s) that are present in a TR prior to delivery of the CEPESC and neoantigen(s)/SNA(s) not present in the individual prior to CEPESC delivery.

In aspects, CEPs comprise a mix of TAA(s) & TSA(s). In AOTI, a CEP comprises ≥3 CAg(s) including, i.a., 1+ TAA(s) and one or more TSA(s).

In aspects, CEP(s) comprise TSA(s) associated with mutations in a RAS protein (Kras), p53, or both. In aspects, such CEP(s) comprise microbial antigen(s), viral antigen(s), synthetic antigen(s), or combinations. In aspects, such CEP(s) include neoantigen(s)/SNA(s).

In aspects, CEP(s) comprise PCRA(s) or CRA(s) that are TSA(s), such as SNA(s). In aspects, the PCRA(s) is from a well characterized cancer, such as a cancer of hematological origin, such as a B cell lymphoma. In aspects, such a TSA comprises a mutated immunoglobulin idiotype (Ig Id) of a B cell receptor (BCR). Such an approach to identifying PCRA TSA(s) is described in Biernacki M et al. Frontiers in Immunology. 11:121 (2020).

In aspects, OSMOA of the TSA(s) of a CEP are from a carcinogen-induced cancer. In aspects, a TSA-ES CEPESC is used to treat such a cancer.

In aspects, a TSA is an AARS of or associated with PPT(s) expressed in melanoma, lung cancer and bladder cancer cells. In aspects, a TSA is an AARS of or associated with PPT(s) expressed in a tumor associated with DNA mismatch repair defects. In aspects, AARS(s) of or associated with PPT(s) of any such cell type are incorporated in CEP(s) as PCRA(s). In aspects, a CEP comprising any such PCRA(s) or CAg(s) comprises one, two, or more CI(s) (e.g., gDS CI(s); NGDCI(s), such as a PD-L1 CI, CTLA-4 CI, CRACC CI, FAP CI, or CD112R CI, e.g., an Ab, Ab FP, or multimeric trap; or both) and ICSTAP(s)/ICITM(s) (e.g., EAT-2(s), SAP(s), or combinations thereof (CT)).

Putative TSA PCRA(s) can be identified through sequencing screening (e.g., DNA or RNA sequencing) focused on finding genomic aberrations that are effectively expressed (e.g., comparing cancer and normal cells using high throughput sequencing, e.g., using whole exon screening); using in silico methods to predict which of the mutations will be presented to T-cells based on proteasome processing and binding affinity to MHC molecules (preferably of the relevant species/population/TR); and testing the identified PCRA(s) in appropriate constructs. Relevant methods for identifying PCRA that are putative TSA(S) and compositions/methods applicable/relevant to the aspects described here are described in Peng, M., et al. Mol Cancer 18, 128 (2019); Jiang, T., Shi, T., Zhang, H. et al. J Hematol Oncol 12, 93 (2019); and Schumacher T, et al. Annual Review of Immunology (2019) Vol. 37:173-200. TSA/neoantigen databases comprising potential PCRA(s) are described in Wu J, et al. Genomics Proteomics Bioinformatics. 2018; 16(4): 276-282 and Xiaoxiu Tan et al. Database, Volume 2020, 2020.

4) Oncoproteins

In aspects, CEP(s) comprise oncoprotein(s). Oncoproteins are intended, without limitation, to refer to PPTs that are capable of inducing cell transformation. Oncogenes encoding oncoproteins arise via point mutations, gene amplifications and gene translocations in a normal gene (known as proto-oncogene) and result in altered gene expression or protein activity levels.

CEP(s) can comprise any suitable number of oncoprotein(s) of any suitable type. In AOTI, OSMOA oncoprotein(s) of CEPs are apoptosis regulators. In aspects, OSMOA oncoprotein(s) of CEPs are cell cycle control proteins. In AOTI, OSMOA oncoprotein(s) of a CEP are cell signaling proteins. In aspects, OSMOA oncoprotein(s) of a CEP are DNA repair proteins. In AOTI, OSMOA oncoprotein(s) of a CEP are growth factors/mitogens (e.g., c-SIS). In aspects, OSMOA oncoprotein(s) of a CEP are growth factor receptors. In aspects, OSMOA oncoprotein(s) of a CEP are transcription factors (e.g., myc).

In AOTI, OSMOA oncoprotein(s) are receptor tyrosine kinases (e.g., EGFR, PDGFR, VEGFR, or Her2). In AOTI, OSMOA oncoprotein(s) are cytoplasmic tyrosine kinases (e.g., Src-, Syk-ZAP-70-, or BTK-family tyrosine kinases). In AOTI, OSMOA oncoprotein(s) are GTPases (e.g., Ras).

In AOTI, OSMOA oncoprotein(s) of a CEP are associated with point mutation oncogenes (e.g., P53, RAS, CDC27, or P16). In aspects, OSMOA oncoprotein(s) of a CEP are associated with translocation oncogenes (e.g., BCR-ABL, TEL-AML-1, or PAX-3-FKHR). In aspects, OSMOA oncoprotein(s) in a CEP are associated with overexpressed oncogenes (e.g., P53 or Her-2).

In exemplary aspects, CEP(s) comprise AARS(s) AW PDGF, ERB-B, ERB-B2, K-RAS, N-RAS, C-MYC, N-MYC, L-MYC, BCL-2, BCL-1, MDM2, BCL-2, tetraspanin oncoprotein CD151, or H-Ras oncoproteins, or CT.

Oncoproteins also include, but are not limited to, viral proteins from RNA and/or DNA tumor viruses such as hepatitis B viruses, SV40 viruses, polyomaviruses, adenoviruses, herpes viruses, retroviruses and the like. Such viral CAg(s) are discussed above, but their inclusion here reflects that there is overlap in these categories, as there are in other categories of CAg(s).

In aspects, CEP(s) comprise Ag(s) against proto-oncogene EP(s). Proto-oncogenes include RAS, WNT, MYC, ERK, and TRK. In aspects, the proto-oncogene(s) are associated with a significant risk of cancer development. In an aspect, a proto-oncogene Ag is associated with MYC, which poses a risk of development of Burkitt's lymphoma.

b. Cancer-Related CRAs and PCRAs

In aspects, CEP(s) comprise cancer-related CRA(s), PCRA(s), or both. Aspects relating to cancer-associated PCRA(s) and CRA(s) are discussed above as well as here. A number of techniques known useful in the identification/ selection of PCRA(s) are known in the art. An example of the application of experimental methods to the identification of a PCRA is described in Huang Y H et al. PLoS One. 2013; 8(6):e64365. Bioinformatics screening approaches are described in, e.g., Nezafat N et al. J Theor Biol. 2014; 349:121-134; Han K C, et al. Sci Rep. 2020; 10(1):5885. Published 2020 Apr. 3; and Bachinsky M M et al. Cancer Immun. 2005; 5:6. Published 2005 Mar. 22. Additional examples of CRA/PCRA methods in cancer contexts are exemplified below.

c. CAg AgVs and Related Sequences

In aspects, OSMOA of the CAg(s) of a CEP are AgV(s) (CAgV(s)). CEPs can comprise any suitable type of AgV(s). In aspects, OSMOA of CAgV(s) are editopes. In aspects, editope(s) comprise AgV(s) with enhanced MHC binding, enhanced MHC:Ag:TCR binding, or both. In aspects, such AgV(s) comprise affinity-enhancing anchor residue modifications. In aspects, AgV(s) comprise mimotope(s). In aspects, AgV(s) comprise heteroclitic AARS(s). In aspects, AgV(s) comprise DIV(s), such as GSRV(s). Examples of such methods are exemplified in, e.g., references 16, 17, 39, 74, 102, 111, 127, 139, 161, and 181 in Buonaguro, L, et al. Clinical and Vaccine Immunology January 2011, 18 (1) 23-34; and Castle J. C et al. Cancer Research. 2012; 72(5): 1081-1091. In aspects, OSMOA CAg(s) of a CEP are associated with one, two, or more ITS(s) (e.g., polyUb(s) upstream, downstream, or both of OSMOA Ag(s)). In aspects, OSMOA ITS(s) of a CEP are PTPS(s). In aspects, OSMOA of PTPS(s) in a CEP are polyUB(s). In aspects, OSMOA of CAg(s) in a CEP are in PE(s). In aspects, OSMOA CAg(s) in a CEP are in gDAgFP(s).

d. Additional Features of CAg CEPs and CAgES CEPESCs

In aspects, CAgES CEPs comprise ICSTAP(s) or ICITM(s). In aspects, ICSTAP(s) comprise EAT-2 PPT(s) or AARS(s). In aspects, EAT-2 AARS(s) are hEAT-2, mEAT-2, or FF or FVs of either thereof.

In aspects, CAgES CEPESC(s) comprise CI(s). In aspects, CI(s) comprise gDS(s) that are CI(s) in TR(s). In aspects, CI(s) comprise NGDCI(s). In aspects, NGDCI(s) comprise PD-L1, PD-1, CRACC, FAP, CTLA-4, LAG-3 CI(s), or CD112R CI(s). In aspects, OSMOA NGDCI(s) comprise Ab AARS(s). In aspects, OSMOA NGDCI(s) lack Ab sequences. In aspects, OSMOA NGDCI(s) are multimeric non-Ab sequence PPTs, such as trap proteins.

In aspects, CAgES CEPs comprise NANCIPI(s). In aspects, OSMOA of the NANCIPI(s) of a CEP are cytokine(s). In aspects, cytokine(s) include IL-2, IL-12, IL-15, IL-7, GM-CSF, IFNg, or combinations. In aspects, OSMOA CAg(s) are Ag(s) associated with melanoma or renal cell carcinoma and CEP comprises GM-CSF. In aspects, OSMOA CAg(s) are associated with cervical cancer and CEP comprise IL-12. In aspects, OSMOA CAg(s) are associated with melanoma and cytokine(s) comprise IL-2.

In aspects, CAg CEPs comprise one or more additional anti-cancer sequences that DOS enhance the immunogenicity of the CEP. In AOTI, such an additional sequence(s) comprises HSP sequence(s)/PPT(s) (e.g., Ag FPs comprising HSP sequences). In AOTI, such sequence(s) comprise co-stimulatory molecule PPT(s)/sequence(s). In AOTI, a CEP comprises a combination of co-stimulatory molecule PPT(s)/sequence(s) (e.g., a TRICOM PPT, comprising B7.1, ICAM-1, and LFA-3 sequences). In AOTI, such sequence(s) comprise a p16INK4a PPT/sequence. In an aspect, additional sequence(s) comprise an hTERT sequence/PPT. In an aspect, additional sequence(s) comprise anti-angiogenic sequence(s)/PPT(s), such as an anti-VEGF Ab, a VEGFIR, or a VEGF2R. In aspects, an additional sequence comprises a non-Cancer Ag, such as an AARS from protein D from *Heamophilus influenzae* B. In aspects, additional sequence(s) comprise adhesion molecule sequence(s)/PPT(s), such as ICAM-1 or VCAM-1. In aspects, additional sequence(s) comprise death receptor PPT(s)/sequences, such as FasL and TRAIL, and IDO. In aspects, additional sequence(s) comprise T reg suppression factors, such as anti-CD25 Ab PPTs, a GITR agonist ligand, or combination. In aspects, additional sequence(s) comprise PPT(s) or sequence(s) that downregulate or block activity of tumor-associated macrophages (TAMs) or other suppressive myeloid cells (e.g., anti-IL-6R Ab, anti-CSF-1R Ab, and anti-CCL2 Ab PPTs, and STING agonist(s)).

In aspects, gDS(s) of a CAgES CEPESC comprise gDSS(s). In aspects, gDS(s) comprise MgDS(s) (e.g., gDS(s) comprising GSRV(s)). In aspects, OSMOA gDP(s), such as OSMOA gDAgFP(s) of a CEP lack gD TM domains. In aspects, OSMOA CAg(s) in gDAgFP(s) of CEPs are positioned downstream of any gDS(s). In aspects, CAg(s) are positioned between gDS(s) and downstream of gDS(s) in gDAgFP(s).

In aspects, CAgES CEPESCs comprise NAMs that comprise EEI(s), ISNS(s), or both. In aspects, OSMOA EPES-NAMs of CEPESCs are NAVs. In aspects, OSMOA NAVs are mRNA vectors. In aspects, OSMOA NAVs are plasmids. In aspects, plasmids are associated with TFAs, such as CaPNP(s). In aspects, CaPNP(s) DOS anti-cancer IR(s). In aspects, NAM(s) are contained in cellular vectors, such as bacterial cell(s) or dendritic cell(s).

In aspects, CEPESCs comprise two or more types of NAMs. In aspects, one type of NAM encodes a gDAgFP comprising CAg(s) and a second type of NAM encodes a second type of gDP, CAg(s) (e.g., PE(s)), ITII(s), CI(s) (e.g., NGDCI(s)), NANCIPI(s), or combinations of some or all thereof.

In aspects, CEPESC(s) are combined with CCC(s). Numerous additional types of combination compositions for cancer are described elsewhere here. Examples of CCC(s) include chemotherapeutics (e.g., chemotherapeutics that deplete immunosuppressive Tregs, MSDCs, or both, such as thalidomide derivatives), indoleamine 2,3-dioxygenase (IDO) inhibitors, STING agonists, agonists of selected TNF receptor family members (e.g., targeting CD40, 4-1BB/CD137, OX-40/CD134, or CD27), tumor suppressor proteins (e.g., APC, DPC4, NF-1, NF-2, MTS1, RB, and p53), inhibitors of undesirable cytokines (e.g., inhibitors of IL-20, TGF-β, IL-6, or combinations), agents that lower the tumor apoptosis threshold (e.g., cisplatin), and γC cytokines such as IL-7, IL-15, and IL-21 or IL-2. Peptidic agents in this list also can be expressed as “additional sequences” in the CEP. Additional agents include lipid and carbohydrate TAA(s) and immunoadjuvants (e.g., Sialyl Lewis, poly ICLC, or oxidized mannose (mannan)), CA19-9-targeted vaccines or CA19-9 Abs, or Anti-TGFβ. Method can comprise associated administration of such agents. Combinations also can comprise chimeric antigen receptor- (CAR-) T cell immunotherapy (e.g., anti-CD19 anti-CD20, anti-CD30, or anti-CD123 CAR-T), cellular therapies (e.g., ex vivo modified CTLs, DCs, and the like) (SFE Todryk S, Jozwik A, de Havilland J, Hester J. Emerging Cellular Therapies: T Cells and Beyond. Cells. 2019; 8(3):284), Toll-like receptor (TLR) agonists (e.g., flagellin, LPS, MPL (3-O-desacyl-4'-monophosphoryl lipid A), or CpG ODN), Prostaglandin E2, Arginase inhibitors, A2AR antagonists, metformin, adenosine receptor or ectonucleotidase inhibitors, DNA methyl transferase (DNMT) inhibitors, histone deacetylase (HDAC) inhibitors, HDAC inhibitors, DNMT-inhibitors, TAA-derivatives (e.g., keyhole limpet hemocyanin (KLH) carrier TAAs), allogeneic tumor cell vaccines, and autologous tumor vaccines. Additional compounds and principles are described in, e.g., Rossi J F et al. Cancer Commun (Lond). 2019; 39(1):34. Published 2019 Jun. 14. and Guo C, et al. Adv Cancer Res. 2013; 119:421-475; and Vermaelen K. et al. Front Immunol. 2019; 10:8. Published 2019 Jan. 22.

e. Applications of CAgES CEPESCs (Methods)

In AOTI, any above-described CAgES CEPESCs can be delivered in EA(s), 1+ times, to induce anti-cancer IR(s). In AOTI, CAgES CEPESCs are delivered to induce protective/prophylactic IR(s). In aspects, CAgES CEPESCs are used therapeutically. In AOTI, CEPESCs are delivered to TR(s) with a malignant cancer. In AOTI, CEPESCs are delivered to TR(s) diagnosed with early-stage cancer (a cancer that is not invasive or metastatic or is classified as a Stage 0, I, or II cancer). In AOTI, TR(s) are diagnosed with a precancerous condition (e.g., having growth that typically precedes or develops into a cancer). In aspects, TR(s) have a non-metastatic condition (e.g., a cancer that is benign or that remains at the primary site and has not penetrated into the lymphatic or blood vessel system or to tissues other than the primary site). In aspects, IR(s) comprise DOS reduction in the invasion of tissues.

In aspects, delivery of EA(s) of CAgES CEPESC(s) induces anti-cancer CE(s). In aspects, delivery of EA(s) of CAgES CEPESC(s) treats or prevents cancer(s). In aspects, such a cancer is an HPV-associated cancer, HBV-associated cancer, ovarian cancer, prostate cancer, breast cancer, brain cancer, head and neck cancer, histiocytic sarcoma, throat cancer, lung cancer, liver cancer, cancer of the pancreas, kidney cancer, bone cancer, melanoma, metastatic cancer, hTERT-associated cancer, FAP-antigen associated cancer, non-small cell lung cancer, blood cancer, esophageal squamous cell carcinoma, cervical cancer, bladder cancer, colorectal cancer, gastric cancer, anal cancer, synovial carcinoma, testicular cancer, recurrent respiratory papillomatosis, skin cancer, glioblastoma, hepatocarcinoma, stomach cancer, acute myeloid leukemia, triple-negative breast cancer, or primary cutaneous T cell lymphoma. In aspects, delivery of EA(s) of CAgES CEPESC(s) treats any cancer AW CAg(s) in the CEP.

In aspects, CE(s) comprise reducing the size of an established tumor or lesion in the subject. In aspects, tumor(s) are reduced in size by about 50% to about 100%, about 60% to about 100%, about 70% to about 100%, or about 80% to about 100%.

In aspects, CE(s) comprise DOS enhancement of tumor regression in TR(s). In aspects, CE(s) comprise increasing tumor regression by about 40% to about 100%, about 60%-100%, about 70%-100%, or 80% to 100%.

In aspects, CE(s) comprise a DOS increase in the rate of survival of TR(s) with or that subsequently develop cancer(s). In aspects, CE(s) comprise a DOS increase in longevity in TR(s). In aspects, CE(s) comprise a DOS enhancement in quality of life.

In aspects, CEPESC(s) are delivered by injection. In aspects, CEPESC(s) are delivered by mucosal administration. In aspects, CEPESC(s) are delivered through electroporation. In AOTI, CEPESC(s) are delivered through biolistic (e.g., "gene gun") methods. Additional delivery methods are DEH.

In AOTI, CAgES CEPESC(s) are administered 2+ times in anti-cancer methods. In AOTI, different CEPESC(s) are administered to TR(s). In AOTI, the same CEPESC is administered 2+ times in methods. In AOTI, methods comprise administering CEPESC(s) and other agents (e.g., in co-administration or sequential administration). In an aspect, a CI or a CI-encoding NAM is administered several days (e.g., about 1 week) after an initial immunization with a CAgES CEPESC. In aspects, the second CI administration is a CAgES CEPESC comprising CI(s) (e.g., CI gDS(s), NGDCI(s), or both).

In aspects, IR(s) include a DOS reduction in aspect(s) of cancer progression (even(s) in the transformation of non-neoplastic cell(s) to cancerous, neoplastic cell(s), the migration of such neoplastic cells, the formation of tumors, or combinations, including cell crisis, immortalization and/or normal apoptotic failure, proliferation of immortalized and/or pre-neoplastic cells, transformation (i.e., changes which allow the immortalized cell to exhibit anchorage-independent, serum-independent and/or growth-factor independent, or contact inhibition-independent growth, or that are associated with cancer-indicative shape changes, aneuploidy, and focus formation), proliferation of transformed cells, development of metastatic potential, migration and metastasis (e.g., the disassociation of the cell from a location and relocation to another site), new colony formation, tumor formation, tumor growth, neotumorogenesis (formation of new tumors at a location distinguishable and not in contact with the source of the transformed cell(s)), and combinations. Aspects also include initiation, promotion, and progression, such as tumor initiation, tumor promotion, malignant conversion, and tumor progression (SFE CANCER MEDICINE, 5th Edition (2000) B.C. Decker Inc., Hamilton, Ontario, Canada (Blast et al. eds.)). Tumor initiation aspects include induction of mitogenesis, compensatory cell proliferation, preneoplasia or hyperplasia, immortalization, and immunosuppression). In aspects, delivery of EA(s) of CAgES CEPESC(s) DOS reduces such event(s) in cell(s) in TR(s).

In aspects, IR(s) comprise increasing the number of CAg-specific IC(s). In aspects, such IC(s) comprise T cells. In aspects, IR(s) include DOS increases in IC(s) in the tumor microenvironment (TME). In aspects, IR(s) include DOS increases in CD4 cells, CD8 cells, or both, in the TME that are specific to CAg(s) in CEP(s). In aspects, IR(s) include DOS increases in anti-cancer cytotoxic IC activity in TR(s). In aspects, cytotoxic activity includes anti-cancer NKC activity, T-cell activity, or both.

In aspects, anti-cancer IR(s) lead to anti-cancer CE(s) in TR(s). In aspects, CE(s) comprise increase in average survival period, increase in TR(s) exhibiting DOS survival benefits, DOS reduction in disease symptom(s), DOS elimination of detectable disease cells, DOS induction of period(s) of disease-free or progression-free survival, objective durable cancer regression(s), or combinations. In aspects, CE(s) include increase in survival in TR(s) by at least about 3 months, at least about 4 months, at least about 6 months, at least about 1 year, at least about 18 months, at least about 2 years, at least about 2.5 years, at least about 3 years, or at least about 5 years, or longer.

In aspects, CAgES CEPESC(s) DOS outperform corresponding Ag peptide vaccines, corresponding viral vector vaccines comprising corresponding CAgES(s), or DNA vaccines comprising standard corresponding CAgES(s) with respect to IR(s) or CE(s). In aspect, CAgES CEPESC(s) DOS outperform current standard of care cancer treatments in TR(s) in terms of IR(s) or CE(s). In aspects, CAgES CEPESC(s) DOS outperform any of the corresponding CAgES compositions described in the Wistar Art, even when the same antigens are used (e.g., the gD-MELAPOLY or gD-E6/E7 constructs described therein).

In aspects, TR(s) are humans. In aspects, TR(s) are NHA(s). In aspects, TR(s) are companion animal(s). In aspects, NHA(s) are dogs.

In aspects, TR(s) are dogs of breeds at high risk for development of a cancer associated with CAg(s) in the CEP (SFE Davis B W et al. ILAR J. 2014; 55(1):59-68). E.g., in an aspect, CAgES comprising CAg(s) that induce IR(s) to histiocytic sarcoma, and EA(s) of such CEPESC(s) are administered to flat-coated retrievers or Bernese mountain dogs. In aspects, CE(s) in such dogs comprise DOS reduction in cancer in joints, viscera, spleen, liver, lungs, muscle, or combinations.

In aspects, a CEPESC exhibits DOS CE(s) in both dogs and humans for cancer(s). In aspects, a CEPESC is evidenced through clinical studies to exhibit DOS CE(s) against cancer(s) in dog(s) and thereafter tested or used as a corresponding anti-cancer treatment in human patients. Thus, in aspects, CEP(s) can comprise PCRA(s) tested for anti-cancer effects in multiple species, such as dogs and humans. In aspects, PCRA(s) are identified by studying cancer-associated differentiations in dog breed(s), between dog breed(s), or both, and incorporating putative CAg(s), such as putative TSA(s) (e.g., putative SNA(s)) into CEP(s), optionally after enhancement (e.g., through association with ITS(s), through modifications to form related AgV(s), or both).

In aspects, a CAgES CEPESC comprises CAg(s) associated with cancer(s) that are considered to exhibit similar/shared characteristics in two or more species. In aspects, such species comprise dogs and humans. In aspects, OSMOA CAg(s) are of or associated with cancer(s) in which some, most, or at least generally all similar molecular, physiological, or other characteristics, such as histopathology, tumor heterogeneity, gene expression patterns, immunology, metastasis, invasion, response to treatment, prognosis, or combinations are deemed similar in art or are similar by objective measurements (e.g., share a significant similarity as compared to comparisons with other cancer(s)) in two or more species, such as dogs and humans. Such conditions in dogs and humans include bladder cancer and lymphoma, which are described in further detail to exemplify aspects.

1) Bladder Cancers

In aspects, CAgES CEPESC(s) are delivered to humans, dogs, or other TR(s) at risk for or diagnosed with bladder cancer (BCCR).

In aspects, CAg(s) in anti-bladder cancer CEP(s) comprise AARS(s) of or related to Her2, NY-ESO-1, MAGE 1, MAGE 2, MAGE 3, MAGE4, LAGE-1, CT Antigen, MAGE C2, EGFR Receptor, Mucin1, Sialyl TN, or combinations. In aspects, OSMOA CAg(s) in anti-BCCR CEP(s) MUC-1, CT Ag, NY-ESO-1, or HER2 Ag(s), or combinations. In aspects, CAg(s) in anti-BCCR CEP(s) comprise PE(s) comprising 2, 3, 4, 5, or more CAg(s). In aspects, PE(s) comprise 2, 3, or the specific TAA(s) cited in this paragraph. In aspects, anti-BCCR CEP(s) comprise oncoproteins relating to EGF-EGFR, ERBB2, UPK3A, ERBB2, FOXA1, ZEB1, ZEB2, CDH1, VIM, S100A1, S100A9, EGFR, or PPARG oncogenes, or combinations. In aspects, OSMOA CAg(s) in anti-BCCR CEP(s) are SNA(s). In aspects, CAg(s) comprise SNA(s) and TAA(s).

In aspects, most or all CAg(s) in CEP(s) are contained in gDFPAg(s). In aspects, OSMOA CAg(s) in PE(s) are associated with MSL(s), FL(s), MSFL(s), or self-cleavage site(s). In aspects, OSMOA CAg(s) are associated with PTPS(s). In aspects, OSMOA of such CAg(s) are AgV(s), e.g., GSRV AgV(s), Ag FPs (e.g., HSP-Ag FP(s)), editopes, or combinations.

In aspects, anti-BCCR CEP(s) comprise ITII(s) (e.g., EAT-2 PPT(s) or AARS(s), such as hEAT-2, mEAT-2, FFs of either, or FVs of any).

In aspects, anti-BCCR CEP(s) comprise CI(s). In aspects, anti-BCCR CEP(s) comprise at least 2 CI(s). In aspects, anti-BCCR CEP(s) comprise gDS CI(s), NGDCI(s), or both. In aspects, CEP(s) comprise or are administered in association with NGDCI(s). In aspects, NGDCI(s) include PD-1 CI(s), PD-L1 (a.k.a., PDL-1) CI(s), CTLA-4 CI(s), LAG3 CI(s), TIM CI(s), CRACC CI(s) (e.g., a CRACC-fc PPT), BLTA-4 CI(s), VISTA CI(s), or combinations. In aspects, anti-BCCR CEP(s) comprise Fibroblast Activation Protein (FAP) PPTs that DOS kill cancer-associated fibroblasts, reduces cancer-associated immunosuppression, or both (FAP can be administered in any CEP of any other aspect as well) (SFE O'Connell A, et al. Cancer Immunol Res Feb. 1, 2019 (7) (2 Supplement) A096).

In aspects, anti-cancer CEP(s), such as anti-BCCR CEP(s) or anti-lymphoma CEP(s) are delivered to TR(s) having a T cell inflamed tumor microenvironment (TME). In aspects, delivery of a CEP to a T cell inflamed TME DOS enhances activity or population of tumor-infiltrating lymphocytes (TIL(s)). In aspects, anti-cancer CEP(s) are delivered to TR(S) having a non-inflamed TME. The TME is understood in the art and generally refers to the matrix of cells surrounding and infiltrating tumors. In detected cancer, TMEs typically are immunosuppressive and both protect tumors from immune attack and nourish growth/progression of neoplastic cells and related biological signals and processes. In aspects, IR(s) induced by CEPESC(s) comprise DOS increases in IFNg production, DOS CD8-mediated cytotoxicity (e.g., in the TME), increased CD4 numbers/activity, or combinations. In aspects, IR(s) comprise detectable destruction of TME(s). In AOTI, CE(s) comprise DOS tumor eradication, tumor growth cessation, tumor size reduction, delayed cancer progression, or CT.

In aspects, a BCCR or another cancer comprises transitional cell carcinoma (TCC) cell(s). In aspects, CEPESCs are used to induce IR(s) in TCC cell(s) or in TR(s) diagnosed with TCC cell-associated cancer(s). TCCs are a major characteristic of BCCR(s) and can be used as an alternative characterization for cancers that typically include BCCR(s). In aspects, a BCCR TR is diagnosed as having C2-Squamous-like, C1-LUAD-enriched, or both C2 and C1 immunological cancer(s) groups.

In aspects, delivery of an anti-cancer CEPESC results in reduced activity or numbers of myeloid-derived-suppressor cells (MSDCs). In aspects, a CEP comprises a factor that reduces or blocks the activity of MSDCs (e.g., a ISNS, such as a CpG sequence) or is administered in association with such a factor (e.g., metformin). In aspects, an anti-cancer CEP comprises PPTs that downregulate/block TReg activity, such as anti-CTLA-4 PPTs, OX40 PPTs, and cytokines, such as IL-2. In aspects, CEP(s) comprise β-Catenin-blocking PPTs (e.g., PPTS comprising AARS(s) of β-Catenin blocking peptides (SFE Hsieh, T et al. Sci Rep 6, 19156 (2016) or anti-β-Catenin Ab PPTs) or AAW β-Catenin blocking agent(s).

In aspects, IR(s) comprise DOS recruitment, expansion, activity, or combinations thereof of DCs, T-cells, BCs, NKCs, or combinations to tumors/TMEs. In aspects, such enhancements are in tissues/organs associated with improved cancer CE(s). E.g., in aspects CE(s) comprise DOS increases in cytotoxic T cells in peritumoral stroma.

In aspects, anti-BCCR CEPESC(s) are combined with CPP(s); delivered AAW CCC(s), CCEPM(s), or both; or methods comprise combinations thereof. In aspects, CCEMP(s) comprise surgical excision of tumor(s), radiation therapy, or both. In aspects, CCC(s) comprise anti-cancer NSAID(s), such as piroxicam; chemotherapeutic agents (e.g., mitoxantrone, vinblastine, or both); or combinations. In aspects, CEPESCs combined with anti-cancer CCC(s), CCEPM(s), or both, DOS enhance anti-cancer IR(s).

In aspects, anti-BCRR CEPESC(s) DOS induce anti-BCCR IR(s). In aspects, EA(s) of anti-BCRR CEPESCs treat or prevent BCCR(s). In aspects, anti-cancer CEPESCs delivered to TR(s) diagnosed with cancer prior to treatment exhibit DOS enhanced periods between recurrence of cancer(s). In aspects, delivering anti-BCRR CEPESC(s) provide an remission rate of more than 35%, such as at least about 40%, at least about 45%, at least about 50% or more in TR(s). In aspects, delivering EA(s) of anti-BCRR CEPESC(s) result in disease stabilization in at least about 50%, 60%, 65%, or 75% of TR(s). In aspects, average survival time in BCCR TR(s) receiving such methods are at least 1 year, 1.2 years, 1.5 years, 2 years, 2.5 years, or 3 years. In aspects, such methods DOS reduce cancer spread. In aspects, such methods DOS improve symptoms of BCRR(s), such as BCRR-associated urinary obstruction.

In aspects, anti-BCCR CEPESC(s) are delivered to humans, NHA(s), or both. In aspects, a NHA is a companion animal, such as a dog. In aspects, dog(s) comprise a terrier breed dog, collie bred dog, or beagle breed dog. In aspects, dog(s) comprise Scottish terriers, West Highland White Terriers, Eskimo Dogs, Shetland Sheepdogs, Keeshonds, Samoyeds, or Beagles. In AOTI, CEP(s) comprise BCCR-associated PCRA(s). In aspects, PCRA(s) are screened to develop CRA(s) in dog(s) & such CRA(s) are delivered as PCRA(s) in CEP(s) in humans until CRA(s) are identified & a CEPESC that induces DOS protective/therapeutic CE(s) WRT BCRR in humans achieved.

In aspects, BCCR related CAg(s) comprise a MPHOSPH1-278 peptide (e.g., SEQ ID NO:717), a DEPDC1-294 peptide (e.g., SEQ ID NO:718) or CT. Such CAg(s) are described in Obara W et al. Jpn J Clin Oncol. 2012; 42(7):591-600. In aspects, BCCR CAg(s) comprise Tumor-Associated Glycoprotein 72 (SFE Nagaya et al. Oncotarget. 2018; 9(27):19026-19038. In AOTI, CCCs or AACs comprise BCG (*Bacillus* Calmette-Guerin) (SFE Obara et al. Cancer Immunol Immunother. 2018; 67:1371-80). In AOTI, CCCs/AACs comprise *Mycobacterium bovis* BCG or *Mycobacterium brumae* BCG-like compositions (SFE, Noguera-Ortega E et al. Sci Rep. 2018; 8(1):15102). In aspects, CAg(s) used in BCCR directed CEPESC(s) comprise 1+, 2+, or 3+ of NY-ESO-1, LAGE-1, MAGE-A1, MAGE-A3, MAGE-A4, MAGE-A10, CT7, CT10, and GAGE. In aspects, CAg(s) comprise MAGE-A3+Ag(s) (e.g., an Ag RVRHRSIOI to SEQ ID NO:455), NY-ESO-1 (e.g., a CAg RVRHRSIOI to SEQ ID NO:456), or CT, optionally in combination with 1 or both of MPHOSPH1 (M phase phosphoprotein-1) and DEPDC1 (DEP domain containing-1 protein) (see also U.S. Pat. No. 9,545,437). In aspects, CAg(s) comprise a HER2/neu CAg (e.g., a CAg RVRHRSIOI to SEQ ID NO:457). In aspects, such CEP(s) comprise anti-cancer NCMIMP(s), such as GM-CSF PPTs. In aspects, CAg(s) in such CEPESCs comprise BRAF CAg(s) (SFE Cintolo J A et al. Melanoma Res. 2016; 26(1):1-11 & Liu Q et al. Cancer Immunol Immunother. 2018; 67(2):299-310). Examples of BRAF CAg(s) that can be included in CEP(s) include sequences RVRHRSIOI to OSMOA of SEQ ID NOs:451-454. BCCR-related aspects of the invention are further exemplified below.

2) Lymphomas

In other aspects, CAgES CEPESC(s) are delivered to dogs, humans, or both at risk for, or diagnosed with, canine lymphoma(s). In aspects, lymphoma(s) comprise diffuse large B-cell lymphomas (DLBCL), marginal zone lymphomas (MZL), or both. In aspects, lymphoma comprises peripheral T-cell lymphoma-not otherwise specified (PTCL-NOS) (high-grade), T-zone lymphoma (TZL) (low-grade), or both. In aspects, lymphoma(s) comprise B-cell malignancies, T-cell malignancies, or both.

In AOTI a lymphoma to be treated/prevented is associated with a viral infection (e.g., HCV, HTLV, KSHV, HIV, or EBV infection). In aspects, an anti-lymphoma CAgES CEPESC comprises VACA(s) or other anti-viral Ag(s) in combination with other CAg(s) (e.g., TSA(s), TAA(s), or both). In aspects, lymphomas are virus-free lymphoma(s) are lymphomas not associated with a particular virus (e.g., EBV-free lymphoma(s)).

In aspects, CAg(s) in CEP(s) delivered to treat or prevent lymphoma(s) comprise AARS(s) of or related to lymphoma-associated Id PPT(s) (Ig-Id protein), survivin, MAGE-A4, Synovial sarcoma X (SSX2), PRAME, NY-ESO-1, TCL1 (Weng J, et al. Blood. 2012; 120(8):1613-1623, PASD1 (e.g., Cooper, C et al. Leukemia 20, 2172-2174 (2006), cTAGE (e.g., Usener D et al. J Invest Dermatol. 2003; 121(1):198-206, or combinations. In AOTI, CAg(s) in CEP(s) against lymphoma(s) comprise lymphoma-associated oncogene AARS(s), such as AARS(s) of or AW CD95, TP53, PTEN, CD79B/A, IκBα, CARD11, API2-MALT1, EZH2, Jak2, or REL oncogenes. In aspects, an anti-lymphoma CEP comprises TERT, MAGE1, NY-ESO1, or SSX-1 Ag(s) or combinations. In AOTI, anti-lymphoma CEPs comprise 2, 3, 4, or more CAg(s). In AOTI, OSMOA CAg(s) are in PE(s). In AOTI, OSMOA PE(s) are in gDAgFP(s). In AOTI, CEP(s) comprise Ag-associated PTPS(s). In AOTI, CEP(s) comprise ICSTAP(s) e.g., EAT-2(s).

In aspects, CEP(s) delivered for treating lymphoma(s) comprise or are administered in association with CI(s). In aspects, CI(s) comprise PD-L1 CI(s), PD-1 CI(s), CTLA-4 CI(s), FAP CI(s), CRACC CI(s) (e.g., CRACCFc), CDR112 CI(s), Lag-3 CI(s), or combinations. In aspects, gDS(s) exhibit CI activity in TR(s). In aspects, gDP(s) are HVEM-binding minimized gDP(s). In aspects, CEP(s) for lymphoma(s) comprise or are delivered in association with NAN-CIPI(s), such as cytokine(s), e.g., GMCSF. In aspects, CEP(s) comprise or are delivered in association with a bruton tyrosine kinase inhibitor, PI3K inhibitor or both. In aspects, CEP(s) comprise or are associated with anti-lymphoma Ab PPT(s), such as anti-CD20 Ab PPT(s). In aspects, anti-lymphoma CAgES CEPESC(s) comprise CCC(s) or are delivered in association with possible CCC(s) or CIIM(s), e.g., delivering a chemotherapeutic (e.g., CHOP (cyclophosphamide, doxorubicin, vincristine and prednisone), PCI-32765, KPT-335, or GS-9219), bone marrow transplant, applying radiation therapy, a thrombospondin-I PPT or mimetic, a NEMO-binding domain PPT that inhibits NFκB, a BTK inhibitor, or delivering any other anti-cancer CCC(s) described elsewhere herein or are otherwise known in the art (SFE Zappasodi R et al Front Immunol. 2015; 6:448 and Richards K L et al. Immunol Rev. 2015; 263(1):173-191). In aspects, 6 month, 9 month, 12 month, 18 month, 24 month, 30 month, 3 year, 4 year, or 5 year survival in TR(s) after application of such method(s) is more than 20%, 25%, 30%, 40%, or 50%. In aspects, method(s) achieve complete DOS remission for 50% or more, 65% or more, or 75% of TR(s) lasting a median over more than 10 months, 12 months, 18 months, or 24 months. In aspects, TR(s) are diagnosed with significant risk of developing lymphoma based on indicator(s) (e.g., paraneoplastic hypercalcemia).

In aspects, the TR receiving anti-lymphoma CEPESC administration is a NHA, e.g., a companion animal, e.g., a dog. In AOTI, dog(s) primarily comprising, generally comprised of, or comprised of (PCGCOOCO) breed(s) at high risk of lymphoma development, e.g., an Old English sheepdog, boxer, pointer, golden retriever, Rottweiler, St Bernard, Scottish terrier, bulldog, Irish wolfhound, Siberian husky, shih tzu, Airedale terrier, Cavalier King Charles spaniel, Yorkshire terrier, cocker spaniel, or basset hound. In aspects, such TR(s) receive PCRA(s) related to lymphoma. In aspects, CRA(s) identified in such animals are tested as PCRA(s) in human trials to develop CEP(s) comprising CRA(s) for treatment/prevention of lymphoma in humans.

2. gD AARS(s) and PPT(s)

CEP(s) comprise gD PPT(s) (gDP(s)). CEP(s) can comprise any suitable number of any suitable type(s) of gDP(s)

and gD AARS(s). In aspects, CEPs comprise gDP(s) that are gD proteins, lacking any heterologous sequence(s) (e.g., a CEP can comprise gD protein(s) that have CI properties with other Ag(s), AgFP(s), EAT-2 PPT(s), and the like). In aspects, CEPs include gDP(s) that are gDS fusion proteins (or gDFP(s)), such as gDAgFP(s).

In AOTI, CEP(s) comprise 2+ types of gDP(s) (e.g., 2+ gDAgFP(s)). In aspects, methods include delivery of 2+ types of gDPES CEPESCs 2+ times.

In aspects, gDP(s) are multimeric PPTs, comprising 2+ associated gDP chains. In aspects gDP(s) are monomeric.

In aspects, CEPs initially comprise immature forms of gDPs that are subsequently processed in one or more ways to form more mature PPTs. E.g., a CEP comprising 2+ gDP portions divided by SCSs can be cleaved forming two separate and more mature gDP portions. In aspects, gDP(s) can comprise a gDSS that is cleaved to form a more mature gDP. In aspects, gDPs can be post-translationally modified by, e.g., glycosylation in COEs. gDPs can include elements that result in 2+ of such modifications.

gDP(s) can comprise any suitable number any suitable type of functional gDS(s) (also sometimes called "gD domains" or "gDDs"). In aspects, OSMOA gDP(s) of a CEP are gDAgFP(s). However, any suitable aspect of the disclosure that relates to gDgDAgFP(s) can be applied to non-FP gDP(s) and vice versa (e.g., composition of gDS(s), origin/relatedness of gDS(s), function of gDS(s), modifications to gDS(s), and combinations thereof and certain uses of gDS(s) (e.g., checkpoint inhibition and signaling).

i. Size and Number of gDS(s)

gDPs can include any suitable number of gDS(s) of any suitable type. Different gDS(s) are defined by (1) detectably different functions, compositions, or both, and (2) in respect of gD sequence fusion proteins (gDSFPs), such as gDAgFPs, based on position of gDS(s) and non-gDS AARSs in the FP. Each gDS(s) of a gDP exhibits a measurable function in TR(s), but additional portions of gDS(s) that do not exhibit discrete functions can also be included in a gDP. Functionality of gDS(s) can vary with TR. E.g., WT HSV-1 gD PPT only exhibits HVEM-related checkpoint inhibition in HVEM-expressing TRs. Typically, each discrete gDS in a gDP is at least about 10 AARs or at least about 15 AARs in length (e.g., 15-425 AAs). In aspects, OSMOA gDS(s) in a gDP are at least 20 AAs in length (e.g., about 20-400, 30-400, 20-380, 30-390, 25-375, 40-380, 40-360, 20-360, 25-350, 30-350, 50-350, or 50-400 AAs). In aspects, OSMOA gDS(s) of gDP(s) are at least about 15% smaller than WT gDP(s), such as ≥25% smaller, ≥33% smaller, ≥40% smaller, or ≥50% smaller (e.g., 25-350 AAs, 30-300 AAs, 30-330 AAs, 40-360 AAs, 40-340 AAs, 40-280 AAs, 20-280 AAs, 20-240 AAs, 20-220 AAs, 40-220 AAs, or 50-200 AAs). In aspects, OSMOA gD(s) of gDP(s) are less than 200 AAs in length (e.g., 20-180 AAs, 20-120 AAs, or 20-100 AAs), less than 120 AAs in length, or less than 60 AAs in length (e.g., 15-45 AAs, 20-50 AAs, 15-30 AAs, 20-30 AAs, or 15-40 AAs).

gDP(s) can comprise any suitable number of gDS(s). In aspects, gDP(s) comprise only 1 gDS. In aspects, gDP(s) comprise 2+ gDS(s). In aspects, gDP(s) comprise 3, 4, or more discrete gDS(s). In aspects, gDP(s) comprise copies of gDS(s). For example, in an aspect, a gDP can be considered a fusion protein comprising two immature gDP(s) (e.g., two fused gDAgFP(s)) and a linker comprising a self-cleavage site, where such two fused gDP(s) can comprise 2+ identical gDS(s), different gDS(s), or combinations.

Different discrete gDS(s), if present, can be organized in any suitable manner in gDP(s). Discrete gDS(s) can be directly linked (e.g., a gDSS and a receptor-binding gDS), indirectly linked (e.g., separated by linker(s), such as MSFL(s)), or both. In gDSFPs, such as gDAgFPs, gDS(s) can be separated by Ag(s) or other components of the FP(s).

ii. Organization of gDSs and Other Sequences in gDFPs

In gDSFPs, e.g., gDAgFPs, gDS can be CB on, ia, organization of gD and non-gD (heterologous-to-gD) AARSs. In general, gDSFPs can comprise any suitable number of non-gDS(s) and gDS(s) in any suitable relationship.

In aspects, a gDSS is positioned at the N-terminus of an immature gDP, such as a gDSFP. In aspects comprising gD receptor binding domain(s) (gDRBD(s)), gDRBD(s) are positioned at or near the N-terminus of the mature gDSFP (e.g., in the first 50%, 33%, 25%, 20%, or 10% of the AARS).

In AOTI, non-GD sequences (NGDS(s), e.g., Ag(s)) are positioned directly or indirectly between two gDSs (in indirect positioning one or both NGDS(s) are bound to gDS(s) through intervening sequences, such as MSL(s) or FL(s) or self-cleavage site AARS(s)). Such positioning is exemplified by the constructs in the Wistar Art that were subject to actual in vivo experiments.

In aspects, NGDS(s) are positioned upstream, downstream, or both of any gDS(s) in a gDSFP. In aspects, OSMOA NGDS(s) of a gDSFP are positioned downstream of any gDS(s) in the PPT. In aspects, NGDS(s) are positioned both between gDS(s) and downstream of any gDS(s). In aspects, NGDS(s) are only located downstream of gDS(s). E.g., in gDAgFPs such PPTs can have a structure such as first gD sequence (gD1), first Ag sequence (Ag1), second gD sequence (gD2), and second Ag sequence (Ag2) (gD1-Ag1-gD2-Ag2). In aspects, a gDAgFP has a gD1-Ag1 structure, gD1-gD2-Ag1 structure, etc. In aspects, gDSFPs incorporate a gDSS, multiple Ag(s), ITS(s) (e.g., PTPS(s)), linkers (Ls), self-cleavage sites (SCSs), and the like, providing gDSFP structures such as gDSS-gD1-PTPS1-Ag1-PTPS2-L-SCS-L-PTPS3-Ag2-PTPS4-L-SCS-L-PTPS5-Ag3-PTPS6-L-SCS-L-PTPS7-Ag4-PTPS8-L-SC-LgD2-PTPS9-Ag9-PTPS10-L-SC-L-PTPS11-Ag10-PTPS12 or similar structures in which one or more Ls, SCSs, PTPSs, or Ags are removed or added to the structure.

In AOTI where gDAgFP(s) comprising PE(s) & ITS(s), ITS(s) can be associated with the PE sequence, each Ag of the PE sequence (as exemplified above), or a mixture thereof. E.g., a gDAgFP can have the structure gD1-PTPS1-Ag1-L-Ag2-L-Ag3-L-Ag4-L-PTPS2-gD2, the structure gD1-PTPS1-Ag1-L-Ag2-L-Ag3-L-Ag4-L-PTPS2, or the structure gDSS-gD1-Ag1-Ag2-Ag3-Ag4-PTPS. In aspects, NGDS(s) are positioned upstream of gDS(s) (e.g., in aspects in which a gDSFP comprises a gD profusion domain (gDPFD)). Such gDSFPs can have a structure such as gDSS-NGDICRTS-Ag1-L-Ag2-L-Ag3-L-Ag4-L-Ag5-L-gDPFD or NGDSS-NGDICRTS-Ag1-Ag2-Ag3-gDPFD. In aspects, CEP(s) comprise 2+ gDSFP(s) having different arrangements of gDS(s) and NGDS(s).

In aspects, OSMGAOA gDS(s) in gDP(s) of CEPs are either of or RVRHROSI, SVSHSOCE, or both to gDS(s) of a virus that infects a species (a) of which OSMGAOA Ag(s) are of or are RVRHROSI/SVSHSOCE (e.g., in the case of CAg(s)) or (b) that is the same as the species that a DCA of which OSMGAOA Ag(s) are from or are RVRHROSI/

SVSHSOCE. E.g., in one aspect CEPs comprise gDP(s) that comprise WT gDS(s) of HSV-1, HSV-2, or both, or FV(s) of such sequences and Ag(s) of a human cancer or Ag(s) of a pathogen DCA that infects humans, such as a human influenza virus, a human-infecting bacteria, or a human-infecting non-viral/non-bacterial pathogen/parasite. In aspects, OSMGAOA gDP(s) in CEPs are of or are related, very related, highly related, or substantially identical (RVRHROSI)/similar, very related, highly similar, or compositionally equivalent (SVRHSOCE) to a gD that infects a first species that is different from the species that either (a) MGAOA Ag(s) are from or (b) a species infected by the DCA from which MGAOA Ag(s) are from or are RVRHROSI/SVSHSOCE. E.g., in aspects, a CEP comprises a gDAgFP comprising HSV gDS(s) and mostly, generally, or only porcine or canine Ags or Ags of a DCA (e.g., a virus) that infects pigs or dogs.

gDAgFP(s) can comprise any suitable number of any suitable type of ITS(s) in any suitable association with Ag(s) of the FP. E.g., a gDAgFP can comprise ERTPS(s) and PTPS(s), exon-targeting ITS(s) and PTPS(s), or other combinations of ITS(s). In aspects, OSMOA ITS(s) in a gDAgFP are linked directly or indirectly to Ag(s) (e.g., PE(s)).

Other elements of CEP(s) can be included in gDSFP(s). E.g., gDSFP(s) can comprise ITII(s) (e.g., EAT-2 AARS(s)), NANCIPI(s) (e.g., cytokine AARS(s)), NGDCI(s) (e.g., PD-L1, CD112R, FAP, or CRACC AARS(s)), or other functional AARS(s). In aspects, gDAgFP(s) comprise OSMOA of such types of additional sequence(s). Such additional sequences can be contained in any suitable number, linked in any suitable manner, and be positioned in any position of the gDSFP. In aspects, such additional sequence(s) are positioned between gDS(s), downstream of any gDS(s) in the FP, or both. In aspects, one or both ends of such sequences are associated with Ls (e.g., MSLs/FLs), SCSs, or both. In aspects, such additional sequences are not positioned between any of the Ag sequences of a gDAgFP.

iii. Composition & Function(s) of gDS(s)/gDD(s)

gDS(s) can have any suitable composition and origin/homology. In aspects, gDS(S) are identical to at least part of an AARS of a WT gD PPT. In aspects, a gDS comprises sequence(s) identical to functional domain(s) of WT gD(s). In aspects, gDS(s) comprise FFs of gDS(s). In aspects, gDS(s) comprise FVs of either a FL WT gD or a FF. In aspects, gDPs comprise gDS(s) that are a mixture of such different types of sequences.

In aspects, OSMGAOA of gDS(s) of gDP(s) in CEPs are AARSs in a WT HSV gD. In aspects, OSMGAOA gDS(s) of gDP(s) are AARSs that occur in a WT HSV-1 gD. In aspects, OSMGAOA gDS(s) of gDP(s) are AARSs of a WT HSV-1 gD. HSV-1 and HSV-2 WT gDs are known and can respectively include any known WT variations (see Uniprot Q69091 and P03172, respectively). In aspects, OSMGAOA gDS(s) of gDP(s) in CEPs are WT AARSs of non-HSV gDs. Examples of such non-HSV gDs include PRV/Suid alphaherpesvirus 1 gD (GenBank: AAO62939.1); Gallid alphaherpesvirus-2/MDV-1 gD (Uniprot Q6764); EHV-1 gD (Uniprot Q6DLD9); EHV-4 gD (Uniprot A0A0Y0A4Z5); Canid alphaherpesvirus 1 gD (Uniprot 041524); BHV-1 gD (Uniprot P0CK29); BHV-5 gD (Uniptor Q65535); Simian herpes B virus gD (Uniprot A0A1X9WGB3); Meleagrid alphaherpesvirus 1 (MeHV-1) gD (Uniprot Q9DPP3); feline herpesvirus 1 (FeHV-1) (Feline viral rhinotracheitis virus) gD (Uniprot Q89634); and Gallid alphaherpesvirus 1 (Infectious laryngotracheitis virus) gD (GenBank Q67644).

gDS(s) of gDP(s) can comprise AARS(s) of 1+, 2+, or 3+ such WT gDP(s). In aspects, OSMGAOA of gDS(s) in gDP(s) of a CEP are FL WT gDS(s). In aspects, OSMGAOA of gDS(s) in gDP(s) of a CEP are FFs of FL WT gDS(s).

In aspects, OSMGAOA gDS(s) in gDP(s) are WT gDS(s) of 1, 2, or more WT gDs. WT gDs herein can include any naturally occurring variations in WT gDs (e.g., G→S at AA50, 30A→V, 281L→I, 353A→V, 367R→H, 369 R→H, 371 R→Q of HSV-1 gD (see and cf., Uniprot Entry Q69091 to SEQ ID NO:29). Variant of gDS(s) also can comprise such natural variations in addition to non-naturally occurring variations. In aspects, OSMGAOA gDS(s) of a gDP are from 1 species of a-HV, such as PRV, HSV-1, HSV-2, BHV-1, BHV-5, EHV-1, or EHV-4. Where an aspect provides for a particular function it can serve to determine if such a substitution is suitable. For example, with respect to HSV-1 gD proteins and polypeptides that can bind HVEM, substitution with a WT HSV-2 gD or N-terminal portion thereof typically would not be suitable, since such gDS(s) do not DOS bind HVEM.

In aspects, gDP(s) comprise chimeric gDS(s) comprising portions of gDS(s) of 2+gD homologs, such as HSV-1 gD and HSV-2 gD, PRV gD and HSV-1 gD, or Canid alphaherpesvirus 1 (CaHV-1) gD and feline herpesvirus-1 (FHV-1) gD. Suitable combinations of sch gDS(s) can function without exhibiting related or similar sequence composition (although such chimeric gDS will typically exhibit structural similarity to one or both counterpart gDS(s) (structural similarity is DEH). In one example of such an AOTI, a construct encodes an N-terminal portion of HSV-2 that replaces SMGAOA known/expected HVEM-binding domain of HSV-1 (e.g., residues 26-57 or 26-58 of HSV-1) combined with a C-terminal portion comprising, e.g., one of SEQ ID NOs: 56, 57, 58, 71, 72, 73, or 74. A chimeric gDS can comprise, e.g., a nectin-1 RBD that is a chimera of a HSV-1/HSV-2 gD RBD & a PRV RBD.

In aspects, gDP(s) in CEPs comprise 1+ variants of WT gDS(s) (gDV(s)). gDVS(s) are RVRHROSI, SVSHSSOCE, or both to 1+WT gDS. In AOTI, a gDVS is RVRHROSI to an HSV gD (e.g., HSV-1 gD). In aspects, a gDVS is RVRHROSI to HSV-2. In aspects, gdVS(s) are RVRHROSI, SVSHSOCE, or both to at least one WT non-HSV gD homolog. In aspects, a gDVS is RVRHROSI to PRV gD. In aspects, a gDP comprises 2+ gDVS that are respectively RVRHR or SI to sequences of 2+WT gDPs.

In aspects, gDP(s) of CEPs DOS bind to Nectin-1, a Nectin-1 homolog, or both. In aspects, gDP(s) comprise RBDs of a WT gDP that bind Nectin-1/Nectin-1 homolog, a chimera of 2+ such gDPs, a FF of such WT gDD(s), or a FV of such gDS(s)/gDD(s). FFs of such gDS(s) typically are RVRHR or SI, SVSHS or CE, or both, to Nectin-1-binding or homolog-binding WT gDS(s). In aspects, variant gDS(s) that serve as Nectin-1/homolog RBD(s) in gDP(s) exhibit DOS higher affinity for Nectin-1, a Nectin-1 homolog, or both, than the counterpart WT gDS. Examples of such gDS(s) are in PRV, HSV-2, and BHV-1, although BHV-1 gD Nectin-1 RBDs exhibit low affinity and FVs of BHV-1 gD Nectin-1 RBDs exhibit enhanced affinity (SFE Connolly S A et al. Virology. 2001; 280(1):7-18).

While gDV(s) can exhibit identity, similarity, or both to any suitable 1+WT gDS(s) (e.g., those DEH), characterization of many aspects of gDS(s) and gDP(s) in this disclosure will be exemplified in reference to HSV-1 gD. This practice is used herein for exemplification and conciseness only and any such disclosure will be understood to simultaneously and implicitly provide support for corresponding gDS(s)/gDP(s) of or that are related to HSV-1 gD homologs, such as those DEH. In some parts of this disclosure explicit reference will be made to gD homologs to reinforce that the scope of this disclosure is not limited to HSV-1 gD-related or even HSV gD-related gDPs/gDSs.

gDP domains can be defined by function (e.g., RBDs), structure (e.g., immunoglobulin folds), or both (e.g., gDSSs). Functional & structural domains can overlap, as can different functional domains. Identifiable domains in HSV-1 gD, e.g., include: (1) in immature gDPs (igDPs) a gDSS (e.g., AAs 1-25); (2) an ectodomain, which typically is made up of (a) an N-terminal flexible region/domain (AAs ~26-58), which can comprise all or parts of RBD(s) (discussed below); (b) a core domain (AAs ~59-280) comprising an Ig-like V fold subdomain (AAs ~80-210) and N-terminal and C-terminal flanking regions (AAs ~59-79 and ~211-280), which also can comprise part/all of RBD(s); (c) a flexible C-terminus domain (FCTD) (AAs ~281-340), most of which is made up by a functionally-defined profusion domain (AAs ~285-335), comprising 2 subdomains (PFD1, PFD2-AAs 285-310 and ~310-335, respectively), and can comprise a N-terminal flexible region (NTFR) "shielding domain" (NTFRSD) when the gDP is in an unbound (receptor-free) state (AAs ~313-331); and (d) a functional Glycosylphosphotidylinositol (GPI) anchoring domain (AAs 234-337) comprising a secretion promoting subdomain (234-294), overlapping parts of both the core domain & FCTD; (3) a transmembrane domain (TMD) (AAs ~340-361); and (4) an intravirion/cytoplasmic domain (AAs ~362-394) comprising an Arg/Lys rich anchor subdomain (AAs ~365-381).

The use of the modifier ~ in connection with the preceding description of WT gDDs arises from variations in gDPs & various characterizations of these domains in the art (though there is general agreement about the core of most of such gDDs). Precisely defining gD RBDs is similarly challenging. E.g., in HSV-1 gD RBDs for HVEM & Nectin-1 are known to partially overlap, but there also is ample evidence that FFs of gDs that do not bind HVEM can effectively, comparably, and in some cases improvingly bind Nectin-1 (SFE Connolly S A, et al. J Virol. 2003; 77(14):8127-8140). As such, RBDs herein can be defined by WT AARSs and FVs thereof that are expected to be sufficient for binding to a referenced receptor, while additional AAs can in cases enhance such binding.

Applying this principle to defining the RBDs of HSV-1 gD (gDRBDs), a HVEM-binding domain (HVEMBD) herein means ~AAs 28-48 (e.g., AAs 26-48). The Nectin-1 RBD (N1BD) of HSV-1 gD is less well defined, but herein means either residues 59-285 or a part thereof (e.g., a sequence defined by N-terminal residue ~AA 59 and ending at about AA 235, 240, 245, 250, 260, 265, 268, 280, or 285. An overlapping domain that contributes to HVEM binding, N1 binding, or both, but which typically is not sufficient for binding either gDR independently is located in positions corresponding to HSV-1 gDs ~AAs 49-58. The overlapping domain gDS can be AW a HVEMBD or N1BD (e.g., a N1BD can comprise AAs 48-285, 48-268, 48-265, 48-260, or 48-250. Functions of an overlapping domain comprise enhancing RBD(s) or to maintaining positioning of RBD(s) similar to positioning of WTC gDD(s) in WT gDP(s).

Further exemplifying how disclosure WRT to HSV-1 gDS(s) can be adapted to other gDD(s), in aspects gDP(s) comprise a PRV N1BD or a FV thereof corresponding to GASAOA (or being RVRHRSI/SVSHSOCE) to PRV AAs 19-350 or a fragment thereof such as AAs 20-340, 20-330, 20-300, 20-280, 20-260, or 20-250. In aspects, gDP(s) comprise a FV of a PRV N1BD in which AAs corresponding to MGASAOA of F29, W40, T137, Y201, Y216, M219-R220, P224 (or P224-Y226), V324, and Y237 of PRV gD are maintained.

gDS(s) that characterize gDP(s) exhibit 1+ defined function(s), such as receptor binding, checkpoint inhibition, ER processing promotion, placement of other gDDs, etc. However, gDS(s) of or related to a WT gDS can exhibit such properties or can exhibit such properties when combined with 1+ heterologous gDS(s) (e.g., a chimeric gDRBD that can bind gD receptor(s)), such that while only portion(s) of such a chimeric or chimeric-like gDS is RVRHRSIOI to any WT gDS it is a suitable gDS as it exhibits 1+ measurable gDS function(s). Functionality of a gDS FF or variant sequence (gDVS) can differ from a WT counterpart. In aspects, a gDS FF or gDVS exhibits suitable, comparable, or improved function(s). In aspects, a gDS FF/gDVS exhibits OSMOA of the functions of its WT counterpart. In aspects, a gDS FF or gDSVS exhibits <all functions of a corresponding WT AARS. Functions of gDS(s) include (1) gDSS functions; (2) receptor binding (e.g., nectin-1, nectin-2, or HVEM) (in gDRBD(s)) and target cell-binding (e.g., DCs, T cells, epithelial cells, or fibroblasts); (3) promoting uptake of the associated gDP (e.g., in a gDFP, such as a gDAgFP); (4) enhancing ER processing of the gDP; (5) enhancing GPI anchoring (6) membrane association (in a gD TMD); or (7) any other measurable function associated with gDD(s) or combinations of any such functions. As DEH, gDP(s) can include non-functional WT gD AARSs or FVs thereof, but such AARS(s) do not characterize the gDP unless explicitly stated. gDP(s) also can comprise gDD(s) that are not discussed in detail herein but that exhibit function(s) (e.g., gDP(s) can be characterized on the inclusion of gDS(s) that DOS contribute or cause oligomerization/dimerization of gDP(s)). Typical functional and structural gDD(s) of gDPs are briefly discussed in turn below.

a. gD Signal Sequence AARSs/PPTs

In aspects, gDPs comprise gDSS(s). In aspects, CEPs, gDPs, or both comprise 2+ gDSSs, such as in immature gDPs comprising two gDP portion(s) separated by SCS(s), or where a CEP comprises two different types of gDPs, such as 2+ gDPAgFPs. In aspects, CEPs or gDP(s) in CEPs comprise only 1 gDSS. In aspects, gDP(s) in CEPs do not comprise any gDSS. In aspects where no gDSS is in a CEP, gDP(s) can comprise heterologous signal sequence(s), such as those DEH or are known in the art. gDPs can comprise any suitable type of gDSS. In aspects, gDPs comprise FLWT gDSS(s). In aspects, gDPs comprise a gDSS that is a FF of WT gDSS(s) or a chimeric gDSS. In aspects, gDPs comprise a gDSS that is a FV of either thereof, such as GSRV gDSS(s). gDSS(s) are typically positioned in the N-terminus of an immature gDP and are typically directly attached to an adjacent sequence. In aspects, the adjacent sequence is a gDRBD sequence or an ETS. In aspects, gDPs comprising a gDSS comprise 1, 2, 3, 4, or more additional gDDs. In aspects, gDPs comprising a gDSS comprise no other gDDs. Examples of WT gDSs include MDV-gD AAs ~1-34 (e.g., GenBank Q9E6L6.1/Uniprot Q6764); AAs ~1-17 of suid alphaherpesvirus 1 (e.g., GenBank: AA062939.1); AAs ~1-19 of EHV-1 gD (e.g., Uniprot Q6DLD9); or AAs ~1-18 of BHV-1 gD (e.g., Uniprot P0CK29). In aspects, inclusion of the gDSS DOS enhances distribution of the associated PPT(s) in TR(s), level of IR(s), or both.

b. Hairpin Forming Domain

In AOTI, OSMGAOA gDP(s) in CEPs comprise domain(s) capable of forming a hairpin structure under typical TR conditions. In AOTI, such a hairpin forming domain (HFD) is RVRHRSIOI, SVSHSOCE, or both to the WT HFD of HSV-1 gD (AAs ~26-47). In aspects, in which a gDP comprises sequence(s) of or RVRHRSIOI/SVSHS-OCE to a PFD or relevant portion thereof (a "displaced subdomain"), at least part of the HFD DOS is AW such a PFD AARS, at least when the gDP is not bound to gDR(s) in the case of gDPs comprising overlapping RBD(s) (e.g., a HVEM RBD). Determination of hairpin formation can be made by structural studies as DEH and KITA (e.g., Connoly et al., J Virol. 2003). In aspects, OSMGAOA gDP(s) in CEP(s) lack a functional HFD or lack any sequence that is RVRHRSIOI, SVSHSOCE, or both to the HFD of a WT gD, such as the HFD of a WT HSV-1 gD. HFDs may be lacking/insufficient to serve as RBDs in other WT gDs. E.g., in PRV N-terminal loop of gD is only about half the size of HSV-1 gD, which has been attributed to the inability of PRV to bind HVEM. SFE Li A et al. PLoS Pathog. 2017; 13(5):e1006314. In aspects, HFDs are within about 85-125%, 90-110%, or 95-105% of the size of the HFD of HSV-1 gD. In aspects, a HFD is capable of binding HVEM suitably, comparably, or improvingly WRT to HSV-1 gD. In AOTI, a HFD is not capable of DOS binding HVEM.

c. gD RBDs

In aspects, OSMGAOA gDP(s) in a CEP comprise gDRBD(s). gDP(s) can comprise any suitable number of any suitable type(s) of gDRBD(s) that bind any suitable gD receptor (gDR). A gDRBD herein is characterized as the minimum AARS that is sufficient to exhibit at least suitable/adequate, and typically at least comparable binding to a gD receptor (gDR) as a WT gD. In aspects, gDP(s) can comprise a single AARS that comprises multiple gDRBDs. For example, a gDP can comprise AAs ~26-280 of HSV-1 gD which comprise most/all of all three RBDs in HSV-1 gD or an FF/FV thereof that exhibits multiple receptor binding function(s).

In AOTI, gDP(s) in CEPs bind 2 or more gDRs. In aspects, gDP(s) bind only a single gDR (e.g., only HVEM, only nectin-1 (N1), or only nectin-2 (N2)). In aspects, the only gD receptor gDP(s) bind is N1, N2, or HVEM. In aspects, gDP(s) bind N2 and N1, but not HVEM. In aspects, gDP(s) bind N2, but not N1 and not HVEM. In aspects, gDP(s) bind N1, but not HVEM or N2. In aspects, gDP(s) at least adequately or at least comparably bind 3OSHS. In aspects, gDP(s) do not bind 3OSHS. In aspects, gDP(s) bind 1+WT gDR(s) other than HVEM, a nectin, or 3OSHS. In aspects, gdP(s) bind a MHC gDR.

gDP(s) can comprise gDRBD(s) of or that are RVRHR-SIOI/SVSHSOCE to WT gD RBD(s) of any suitable α-HV gD or FFs thereof, and gDP(s) can comprise functional chimeric RBD(s). Most α-HV comprise gDs (a notable exception is human alphaherpesvirus 3 (HHV-3), usually referred to as the varicella-zoster virus (VZV)). Most gDs bind either HVEM or a HVEM/homolog, a Nectin (e.g., a Nectin-1 (e.g., HSV-1, HSV-2, PRV, SuHV-1, BHV-5, and BHV-1), Nectin-2 (PRV, HSV-2, and mutant HSV-1), or nectin-like-5/CD155 (e.g., PRV and BHV-1), or 3-O-sulphated heparan sulphate receptor ("3OSHS") (e.g., HSV-1, but not BHV-5) (SFE Krummenacher C et al in Madame Curie Bioscience Database. Austin (Tex.): Landes Bioscience; 2000-2013 and Levings, R., graduate thesis, Iowa State Univ., 2012). The HSV-1 gDRBDs for Nectin-1, HVEM, and 3-O-S HS are DEH, as are select examples of RBDs for such receptor(s) in other α-HV gDs. In aspects, gDS(s) comprise other gD RBD(s). E.g., a EHV-1 gDRBD, EHV-4 gDRBD, or RVRHRSI FV gDRBD can comprise a MHC I RBD. See Azab W et al. J Virol. 2012; 86(4):2031-2044. Aspects of RBDs usable or adaptable to the design/selection of RBD(s) in gDP(s) of CEPs are discussed in numerous references cited elsewhere here and in, e.g., Spear P G, et al. Virology. 2006; 344(1):17-24 In aspects, OSMGAOA gDP(s) in CEPs lack any gDRBD. In aspects, OSMGAOA gDP(s) in CEPs comprise ≥1 gDRBDs, ≥2 gDRBDs, or ≥3 gDRBDs. In aspects, OSMGAOA of the gDRBDs in CEPs comprising ≥2 gDRBDs are from WT gDS(s) or are RVRHROSI to gDRBDs of the same α-HV. In aspects, ≥2 gDRBDs in a CEP are from WT gDS(s) or are RVRHROSI to gDRBDs of two different species of α-HV (e.g., PRV and HSV-1). Examples and aspects of RBDs are DFEH.

1) HVEM RBD/Binding Characteristics/Checkpoint Inhibition

In aspects, OSMGAOA gDP(s) in CEPs bind HVEM with a suitable, comparable, or improved affinity as compared to a corresponding WT HVEM-binding gDP (e.g., HSV-1 gD) and, accordingly, in aspects OSMGAOA of gDP(s) in a CEP comprise ≥1 HVEM-binding gDRBD(s). In aspects, OSMGAOA of such gDP(s) exhibit CI activity in HVEM-expressing TRs. In aspects, a HVEM-binding RBD is identical to a WT gDRBD. In aspects, a HVEM-binding RBD is a FV that is RVRHROSI to a WT HVEM-gDRBD. E.g., in one aspect a HVEM-gDRBD is a FV of an HSV-1 HVEM-gDRBD that comprises a variation at AA 22. In aspects, a CEP comprises gDP(s) comprising HSV-1 gD HVEM-gDRBD FVs in which G47, Y48, P42, K51, Q52, and G59 are maintained, and optionally further in which OSMGAOA of AAs 36, 37, 40, 53, and 54 is maintained. In aspects, GAOA of AAs 32-40, 49-57, or both of HSV-1 are maintained. In aspects, HSV-1 gD AA 27 39, or 47 are also/alternatively maintained, with such residues DOS contributing to HVEM binding. In aspects, CEPs comprise a FV HVEMBD in which OSMGAOA of the AAs in positions 43, 45, 46, and 49, and OSMGAOA of the residues in overlapping domain AAs 50, 55, 56, 57, or 58 (L, K, S, P, G, E, L, or T, respectively) are substituted with a suitable substituting AA (e.g., an Ala). In aspects, AAs 101, 99, 64, 61, and 60 in the Nectin-1 RBD also are maintained and DOS enhance HVEM binding of such a gDP. In aspects, a FV HVEMBD comprises a sequence according to the formula of SEQ ID NO: 719. In aspects, no more than 75% (6/8), no more than 50% (4/8), or nor more than 3, 2, or 1 of such X AAs varies from corresponding AA(s) in HSV-1 gD.

In aspects, a gDP comprising a HVEMBD lacks SMGAOA of any gD PFD (e.g., most, generally all, substantially all, or all of any residues corresponding to residues 315-324, 310-324, 315-394, or AAs 310-394 of HSV-1 gD). In aspects, such gDP(s) exhibit significantly enhanced affinity for HVEM than WT HSV-1 gD (e.g., at least 2×, 5×, 10×, 20×, 50×, 75×, or 100× greater affinity). In aspects, a gDP comprises a gDS in which MGAOA of such a portion of the PFD is maintained but in which one or more substitutions are introduced that DOS enhance HVEM affinity (e.g., substituting W319 with a different residue, e.g., Ala). In aspects, such gDP(s) exhibit significantly improved $K_{ON}$ values as compared to WT HSV-1 gD with respect to HVEM binding. In aspects, any such gD may maintain portion of a PFD or adjacent sequence comprising, e.g., AAs 259-300 of HSV-1 gD or a RVRHROSI sequence. In aspects, such gDP(s) exhibit a significantly lower $K_{off}$ than gDP(s) lacking such a sequence. In aspects, a HVEMBD gDP that comprises a core domain comprises substitution(s) at AAs corresponding to AAs 165, 240, 247, 248, or 256 of HSV-1 gD, in aspects at least 2 or 3 thereof, the substitutions resulting in DOS enhanced HVEM binding as compared to WT HSV-1 gD.

In aspects gDP(s) comprising a HVEMBD & a PFD do not include any insertions of ≥12, ≥10, ≥8, ≥7, more than 6, more than 5, or more than 3 residues between the HVEMBD and PFD. In aspects, gDP(s) comprising a HVEMBD & a PFD comprise no insertions that DOS reduce HVEM binding.

In aspects, a gDP exhibits a KD of about 0.5-6.5 (e.g., ~2-6)×10$^{-6}$ M for HVEM, a $K_{on}$ of about 3-150 (e.g., ~50-150)×10$^3$ M WRT to HVEM, a $K_{off}$ of 1-6 (e.g., ~3-6)× 10$^{-2}$ M WRT to HVEM, or a combination thereof. Methods for assessing HVEM binding are described in, e.g., Rux A H et al. Journal of Virology. 1998 September; 72(9):7091-7098; Lazear E et al. Virology. 2014; 448:185-195; and other references DEH. In gDP(s) lacking a functional HVEMBD, such gDP(s) can exhibit DOS lower affinity characteristics than these minimum characteristics.

In AOTI, gDP(s) of CEPs comprising a HVEMBD(s) exhibit DOS gD CI effects in HVEM-expressing TRs ("HVEM TRs"). In aspects, gDP(s) bind HVEM with at least comparable affinity as BTLA or a BTLA homolog binds HVEM. In AOTI, gDP(s) bind HVEM with DOS greater affinity than exhibited by BTLA PPTs in cells or TRs (or population of similar cells or TRs, e.g., as determined by a statistically significant population in an in vivo or in vitro study). In AOTI, such gDP(s) in CEPs DOS induce enhanced antigen specific IR(s).

In AOTI, CEPs comprise LIGHT PPT(s) that DOS enhance(s) IR(s). In aspects, methods comprise the use of such LIGHT PPT(s) or other stimulators of a HVEM-mediated checkpoint pathway as A. In aspects, CCs comprise such LIGHT PPT(s) or HVEM pathway activator(s) as CCCs.

In aspects, OSMGAOA of gDP(s) in a CEM comprising HVEMBD(s) comprise less than an all of the gDD(s) in any WT gD(s) related to the HVEMBD(s) (e.g., in aspects gDP(s) comprise that comprise an HSV-1 HVEMBD or a FV thereof and lack one or more other domains corresponding to the other domains of HSV-1 gD, such as a nectin-1 RBD, a PFD, a TMD, or an intravirion domain. In aspects, CEPs comprise gDP(s) that consist or consist essentially of HVEM RBD(s) (WT or FV) or in which the only gDD(s) are HVEMRBD(s).

In aspects, OSMOA gDP(s) in CEPs lack any HVEMBD that binds HVEM in a comparable or better manner (e.g., a reduction of 50%, 65%, 75%, 90% or more) (e.g., a HSV-1 gD lacking AAs 32-40 or suitable substitutes therefore may exhibit a 90% reduction in HVEM binding). In aspects, OSMGAOA gDP(s) in CEPs lack any gDD that exhibits significant binding of HVEM, HVEM-mediated checkpoint inhibition in TR(s), or both. In aspects, gDP(s) in CEPs do not exhibit HVEM-mediated checkpoint inhibition, significant HVEM binding, or both. In aspects, OSMGAOA gDP(s) in CEPs lack any gDS(s) including AARS(s) that is related or similar to any EL WT gD HVEMBD.

2) Nectin-1 RBD/Binding Characteristics

In AOTI, gDP(s) in CEPs comprise N1BD(s). In aspects, gDP(s) comprise ELWT gD N1BD(s). In aspects, gDP(s) comprise FFs of such gDS(s). In aspects, gDP(s) comprise chimeric N1BD(s) (e.g., a PRV & HSV-1 N1BD).

In aspects, gDP(s) comprise FV(s) of a WT N1BD AARS that is RVRHROSI to a WT gD N1BD (e.g., HSV-1 gD, BHV-1 gD, or PRV gD). In aspects, a FV N1BD is RVRHROSI to the WT HSV-1 gD N1BD. In aspects, such a FV N1BD retains AAs corresponding to Tyr63, Asp240, Arg247, and Phe248 of HSV-1 gD or AAs that correspond in function, position, or both in HSV-1 gD.

In aspects, gDP(s) exhibit an affinity for Nectin-1 that is comparable or superior to the affinity between CD96 and Nectin-1 in TR(s). In aspects, gDP(s) exhibit affinity for Nectin-1 that is DOS less than the affinity of CD155 for Nectin-1 in TR(s).

In AOTI, gDP(s) comprise a sequence that is RVRHRSIOI, SVSHSOCE, or both to SEQ ID NO:56 (residues 58-255 of HSV-1 gD). In aspects, gDP(s) comprise a gDS that is RVRHRSIOI, SVSHSOCE, or both to SEQ ID NO:57 (residues 58-269). In aspects, gDP(s) comprise a gDS that is RVRHRSIOI, SVSHSOCE, or both to SEQ ID NO: 72 (residues 58-290), SEQ ID NO:71 (residues 58-302); SEQ ID NO:58 (residues 58-313); or SEQ ID NO:73 (residues 58-340). In AOTI, gDP(s) comprise a gDS that is RVRHRSIOI, SVSHSOCE, or both to SEQ ID NO:53 (residues 55-255 of HSV-1 gD); SEQ ID NO:54 (residues 55-269); SEQ ID NO:55 (residues 55-313); or SEQ ID NO:69 (residues 55-340). In AOTI, gDP(s) comprise a gDS that is RVRHRSIOI, SVSHSOCE, or both to SEQ ID NO:50 (residues 48-255 of HSV-1 GD); SEQ ID NO:51 (residues 48-269); SEQ ID NO:64 (residues 48-302); SEQ ID NO:52 (residues 48-313); or SEQ ID NO:64 (residues 48-340 of HSV-1 gD). In AOTI, gDP(s) comprise homologous N1BD sequence(s) from a non-HSV-1 gD.

In aspects, gD(s) comprise both N1BD(s) and HVEMBD(s). In one such aspect, gDP(s) comprise a gDS that is RVRHRSIOI, SVSHSOCE, or both to SEQ ID NO:40 (residues 26-255); SEQ ID NO:35 (residues 26-269); SEQ ID NO:45 (residues 25-313); or SEQ ID NO:82 (residues 26-340). In aspects, gDS(s) comprise a HVEM1BD, N1BD, or both, which are RVRHRSIOI/SVSHSOCE to homologous gD sequences from a non-HSV-1 WT gD.

In aspects, a first mature gDS (a gD1) of a mature gDP, PCGCOSCOOCO a HVEMBD, a N1BD, or combined HVEMBD&N1BD gDS, and the gDP comprises one or more gDS(s) downstream of such gD1 sequence (e.g., a gD2 sequence). E.g., in aspects, a gDP comprises an above-described HSV-1 gD or HSV-1 gD related HVEMBD, N1BD, or combined HVEMBD-N1BD gDS as a gD1 sequence and a second gDS (a gDS-2 sequence) that is RVRHRSIOI/SVSHSOCE to a portion of a WT gD, such as HSV-1 gD, that begins at a position corresponding to the position following the C-terminus of the gDS in gD-1 or a position that is 2, 3, 4, 5, 6, 7, 8, 9, 10, 12, 15, 16, 18, 20, 22, or 25 residues downstream of such residue, and that ends at a position corresponding to HSV-1 gD residue 394, residue 375, residue 360, or residue 350, residue 340, residue 335, residue 315, residue 310, residue 308, residue 300, residue 290, or residue 285 of HSV-1 gD. In aspects, such a gDP is a gDFP comprising one or more intervening AARSs positioned between the gD1 and gD2 portions of the gDP. In aspects, the inclusion of such intervening sequences does not prevent the gDD(s) of the gDP from exhibiting suitable, comparable, or improved functionality as compared to the WT counterpart gDD(s). In aspects, such a gDFP is a gDAgFP comprising one or more Ag sequences positioned between gD1 and gD2, such as at least 2, 3, 4, 5, 6, 8, or 10 Ag(s), which are optionally AW PTPS(s), SCS(s), FL(s)/MSL(s), or CT.

In aspects, CEPs comprise gDAgFP(s) comprising a gD1 as described above (e.g., SEQ ID NO:57 (residues 58-269 of HSV-1 gD); SEQ ID NO: 72 (residues 58-290), SEQ ID NO:71 (residues 58-302); SEQ ID NO:58 (residues 58-313); or SEQ ID NO:73 (residues 58-340), or a FF or FV of any thereof) and that further comprise a gD transmembrane domain (e.g., residues 341-361 of HSV-1 gD or a homologous sequence or a FF or FV of either) or cytosolic/ectodomain (e.g., residues 361-394 of HSV-1 gD or a homologous sequence or a FF or FV of either) (e.g., SEQ ID NO:66 (corresponding to residues 48-394), SEQ ID NO:83 (corresponding to mature HSV-1 gD, residues 26-394), or SEQ ID NO:70 (corresponding to residues 55-394 of HSV-1 gD). In aspects, Ag(s) can be directly or indirectly bound to the gD sequence upstream of the gD sequence(s), downstream of the gD sequence(s), or both. In AOTI, OSMGAOA Ag(s) in the gDP are downstream of any gDS in the gDP.

In aspects, gDP(s) comprise an intervening heterologous AARS between a HVEMBD and a N1 BD. In aspects, such an insertion occurs at a position corresponding to residue 47 of HSV-1 gD.

In aspects, any insertions of heterologous AARSs in a N1BD do not eliminate suitable or comparable Nectin-1 binding. In aspects, any such insertions do not DOS reduce N1 binding. In aspects, no heterologous AARS of more than 15 AAs, no more than 10 AAs, no more than 5 AAs is inserted between any gDS that is RVRHRSIOI to AAs 59-240 of HSV-1 gD in a gDP.

In aspects, a gDP binds Nectin-1 with at least 1.5×, at least 2×, at least 2.5×, at least 3×, at least 4×, or at least 5× the affinity of WT HSV-1 gD (e.g., at least 7, 8, or 9× the affinity). In aspects, such a gDP comprises a Nectin-1 binding domain that is more related to the N1BD of PRV gD than HSV-1 gD. Aspects of determining affinities and relative aspects of PRV, BHV-1, and HSV gDs are described in, e.g., Connolly S A et al. Virology. 2001; 280(1):7-18. Nectin-1 binding characteristics adaptable to this aspect are described in Li A et al. PLoS Pathog. 2017; 13(5):e1006314. Published 2017 May 19. doi:10.1371/journal.ppat.1006314

Other N-terminal first sequence (gD1) and C-terminal (gD2) second sequence combinations that can be for internal antigen sequence gD fusion protein constructs that can be used in some compositions and methods of the invention are provided in the Wistar Art (SFE Col. 8 of U.S. Pat. No. 8,962,816). In aspects, the gDP comprises gD1 and gD2 sequences that is not described in the Wistar Art (e.g., by inclusion of different residues, smaller gDs that are FFs, or FVs not contemplated in the Wistar Art). In aspects, gDP(s) lack one or more residues or sequences associated with HVEM binding, lack a gD intravirion/cytosolic domain, lack a TMD, comprise Ag(s) that are positioned downstream of any gDS in the FP, initially comprise a gDSS, or comprise combinations of such features.

In aspects, gDP(s) comprising a N1BD lack a gD TMD & cytosolic domain. In aspects, such gDP(s) exhibit DOS higher affinity for Nectin-1 than gDP(s) with such gDDs.

In aspects, gDP(s) comprising a N1BD, HVEMBD, or both, lack any gDS corresponding to residues 310-394 of HSV-1 gD. In aspects, such gDP(s) exhibit DOS enhanced binding for one or both gD receptors. In aspects, such gDP(s) exhibit at least 10×, at least 20×, at least 30×, or at least 50× affinity for Nectin-1 than WT HSV-1 gD.

In aspects, a gDP comprises a heterologous ETS upstream of a N1BD, in essence taking the place of the HVEMBD in HSV-1 gD. E.g., a DEC-205-binding domain can be located in such a position, such as a DEC-205-binding keratin AARS.

In aspects, the N1BD comprises up to about residue 250 of HSV-1 gD or a corresponding residue of a homolog or FV. In aspects, residues 240, 247, and 248 of HSV-1 gD are maintained as part of the N1BD. In aspects, such gDP(s) exhibit DOS enhanced binding of Nectin-1 due to the presence of such residues. In aspects comprising a HVEMBD or 30SHSBD, such residues are deleted, or such a section is deleted/not present (e.g., residues corresponding to AAs 240-250 of HSV-1 gD are deleted,) and the associated gDP exhibits DOS enhanced binding of HVEM, 30SHS, or both.

In aspects, gDP(s) comprise a FV of an HSV-1 gD N1BD. In aspects, SMGAOA of the AAs corresponding to R61, V62, Y63, H64, Q157, R159, and V239,of HSV-1 gD are retained (in this disclosure WT gD AAs are counted from the first residue of the gDSS). In aspects, SMGAOA of AAs S241, I242, G243, M244, L245, N252, T255, V256, and Y259 also are retained. In aspects, all of V2229-V248 are retained. In aspects, one, some, or all (OSOA) of AAs P48, L50, and Q52 of/near the overlapping domain are also retained. In aspects, Q101, N102, and M110 are retained. In AOTI in which a gDP comprises HVEMBD and N1BD sequences at least related to HSV-1 gD counterparts both L50 and Q52 are retained & both residues contribute to both Nectin-1 and HVEM binding. In aspects, gDPs comprise an HSV-1 N1BD FV that comprises substitutions at residues corresponding to OSMOA of T91, N107, S109, or F154. In aspects, gDPs comprise N1BD FVs that has substitutions at positions corresponding to HSV-1 AAs 59, 240, 247, or 248. In aspects, AAs corresponding to OSMOA of HSV-1 gD AAs 107, 109, 154, 240, 247, or 248 are retained.

Exemplifying how such principles can be extended to other α-HV gDS(s) & gDSVs, in aspects gDP(s) comprise an HSV-2 gD N1BD (HSV-2 gD AAs 48-258). In aspects, gDP(s) comprise a FV of a HSV-2 N1BD that is RVRHROSI/SVSHSOCE to HSV-2 N1BD & that retains AAs corresponding to MGAOA of HSV-2 gD AAs P48, L50, D51, Q52, R61, V62, Y63, H64, Q157, R159, P223, V229, D240, S241, I242,G243, M244, L245, P246, R247, F248, N252, V256,&Y259.

In aspects, a gDP comprises an N1BD that comprises sequences that are VRHRSIOI to WT Nectin-1 BD patch 1 and patch 2 sequences or that are VSHSOCE and within about 5 angstroms of the patch 1 and patch 2 nectin-1 binding domains of HSV-1 gD or HSV-gD when structurally aligned (e.g., HSV-2 gD patch1 residues comprising P23, L25 to Q27, F223, N227, V231, and Y234 and HSV-2 gD patch 2 residues comprising R36 to H39, Q132, R134, P198, and V214 to R222).

In aspects, gDPs comprise a N1BD sequence according to the formula X1-X2-X3-X4-X5-X6-X7-X8-X9-X10--C--X12-X13-X14-X15--L--X17-X18-X19-X20-X21-X22-X23-X24-X25-X26-X27-X28-X29-X30-X31-X32-X33-X34-X35-X36-X37-X38--W--X40-X41-X42-X43-X44-X45-X46--C--X48-X49-X50-X51-X52-X53-X54-X55-X56-X57-X58--C--X60-X61-X62-X63-X64-X65-X66-X67--C--X69-X70-X71-X72-X73-X74-X75--W--X77-X78-X79-X80-X81-X82-X83-X84-X85-X86-X87-X88-X89-X90-X91--G--X93-X94-X95-X96-X97--P--X99-X100-X101-X102--G--X104--Y--X106-X107-X108-X109-X110-X111-X112-X113-X114-X115-X116-X117-X118-X119-X120-X121-X122, wherein (i) X2, X6, X7, X10, X15, X19, X23, X24, X27, X28, X42, X43, X44, X53, X57, X60, X64, X67, X69, X70, X73, X77, X79, X82, X86, X102, X110,X115, X116, and X117 can be any residue; (ii) X78 can be any residue or is absent; and (iii) X1 is V, T, or N, in one aspect is V or T; X3 is a Y or H; X4 an A, T, V, or L; X5 is a V, T, R, or I; X8 is empty or any residue (S); X9 is an R, A, D, or E; X12 is an R, D, G, or S; X13 is an S, M, V, F; X14 is V, L, or A; X17 is an N, I, or W; X18 is an A, S, or P; X20 is an S, P, T, or G; X21 is an E, Q, D, or N; X22 is an A, V, P, or I; X25 is I, T, L, V, or M; X26 is V, L, or I; X29 is an A, L, Q, or I; X30 is any 0-6 residues; X31 is a P, V, S, L or Q; X32 is any 0-7 residues; X33 is a Y or F; X34 is an N, R, D, or E; X35 is an L or A; X36 is a T, H, L, or S; X37 is an I, V, or L, X38 is an A, I, S or V; X40 is F or Y; X41 is R, K, or V; X45 is an N, G, D, A, or M; X46 is 0-6 of any residues; X48 is an A, G, E, or T, or is absent; X49 is an I, R, H, Y, or is absent; X50 is a P or L; X51 is a I, L, or M; X52 is a T, Y, L, or F; X54 is a M, I, R, or K; X55 is an E, D, or Q; X56 is a Y, F, or M; X58 is an E, D, N, or L; X61 is a Y, P, T, or D; X62 is an N, R, D, K, Q, or V; X63 is a K, Q, E, or R; X65 is an L or F; X66 is a G or S; X71 is an R, K, S, or Q; X72 is a T, N or S, in one aspect T or S; X74 is a P, G, S, D, or Q; X75 is an R, F, M, W, or Y; X80 is a Y, L, or S; X81 is a D, A, V, or T; X83 is an F, Y, T, or S; X84 is an S, A, M, or T; X85 is an A, Y, F, or L; X87 is an S, T, or G; X88 is an E, D, or R; X89 is a D or N; X90 is an N, E, or G; X91 is an L or A; X93 is a F or L; X94 is an L, I, V, or T; X95 is a M, I, F, or L; X96 is a H, A, V, M, or F; X97 is an A or S; X99 is an F, R, Q, P, or A; X100 is an E, L, F, or A; X101 is a T, V, N, or L; X104 is a T, Q, or L; X106 is an L, R, or T; X107 is an R or L; X108 is an L, A, V, or T; X109 is a V, L, or I; X111 is an I or V; X112 is an N, D, E, or G; X113 is a D, G, N, or R; X114 is a W, T, V, E, D, S, or F; X118 is a T, S, or A; X119 is a Q, D, or L; X120 is a F, I, or V; X121 is a I, M, L, or T; and X122 is a L, V, or F. (FORMULA 1, SEQ ID NO: 744). In aspects, such a gDP is a gDFP, such as a gDAgFP. In aspects, a gDP comprises a sequence according to the formula X1-X2-X3-X4-X5-X6-X7-X8-X9-X10--C--X12-X13-X14-X15--L--X17-X18-X19-X20-X21-X22-X23-X24-X25-X26-X27-X28-X29-X30-X31-X32-X33-X34-X35-X36-X37-X38--W--X40-X41-X42-X43-X44-X45-X46--C--X48-X49-X50-X51-X52-X53-X54-X55-X56-X57-X58--C--X60-X61-X62-X63-X64-X65-X66-X67--C--X69-X70-X71-X72-X73-X74-X75--W--X77-X78-X79-X80-X81-X82-X83-X84-X85-X86-X87-X88-X89-X90-X91--G--X93-X94-X95-X96-X97--P--X99-X100-X101-X102--G--X104--Y--X106-X107-X108-X109-X110-X111-X112-X113-X114-X115-X116-X117-X118-X119-X120-X121-X122, wherein X1 is V, T, or N, in one aspect is V or T; X2 is Y, R, K; X3 is a Y or H; X4 is an A, T, V, or L; X5 is a V, T, R, or I; X6 is an L, S, P, Y, or R; X7 is an E, A, L, T, D, M, or V; X8 is empty or any residue (S); X9 is an R, A, D, or E; X10 is an A, P, N, S, or G; X12 is an R, D, G, or S; X13 is an S, M, V, F; X14 is V, L, or A; X15 is an L, A, V, or E; X17 is an N, I, or W; X18 is an A, S, or P; X19 is a P, D, F, I, E, or N; X20 is an S, P, T, or G; X21 is an E, Q, D, or N; X22 is an A, V, P, or I; X23 is an P, G, D, V, K, or E; X24 is a Q, R, Y, A, S, or D; X25 is I, T, L, V, or M; X26 is V, L, or I; X27 is an R, W, N, L, or S; X28 is a G, E, S, T, or A; X29 is an A, L, Q, or I; X30 is any 0-6 residues; X31 is a P, V, S, L or Q; X32 is any 0-7 residues; X33 is a Y or F; X34 is an N, R, D, or E; X35 is an L or A; X36 is a T, H, L, or S; X37 is an I, V, or L, X38 is an A, I, S or V; X40 is F or Y; X41 is R, K, or V; X42 is M, I, T, L, or V; X43 is G, E, A, S, T, or I; X44 is G, S, D, R, K, Q, or D; X45 is an N, G, D, A, or M; X46 is 0-6 of any residues; X48 is an A, G, E, or T, or is absent; X49 is an I, R, H, Y, or is absent; X50 is a P or L; X51 is a I, L, or M; X52 is a T, Y, L, or F; X53 is a V, Y, F, L, or R; X54 is a M, I, R, or K; X55 is an E, D, or Q; X56 is a Y, F, or M; X57 is a T, A, Y, R, or F; X58 is an E, D, N, or L; X60 is a S, E, D, Q, or G; X61 is a Y, P, T, or D; X62 is an N, R, D, K, Q, or V; X63 is a K, Q, E, or R; X64 is a S, H, V, P, E, or L; X65 is an L or F; X66 is a G or S; X67 is an A, Y, R, T, or E; X69 is a P, R, K, S, A, or L; X70 is an I, Y, R, V, L, M, or K; X71 is an R, K, S, or Q; X72 is a T, N or S, in one aspect T or S; X73 is a Q, P, T, L, or A; X74 is a P, G, S, D, or Q; X75 is an R, F, M, W, or Y; X77 is an N, D, W, S, L, K, or A; X78 is absent or is a S, T, R, E, P, or V; X79 is a Y, F, P, R, S, or D; X80 is a Y, L, or S; X81 is a D, A, V, or T; X82 is an S, G, M, K, or P; X83 is an F, Y, T, or S; X84 is an S, A, M, or T; X85 is an A, Y, F, or L; X86 is a V, P, T, I, or L; X87 is an S, T, or G; X88 is an E, D, or R; X89 is a D or N; X90 is an N, E, or G; X91 is an L or A; X93 is a F or L; X94 is an L, I, V, or T; X95 is a M, I, F, or L; X96 is a H, A, V, M, or F; X97 is an A or S; X99 is an F, R, Q, P, or A; X100 is an E, L, F, or A; X101 is a T, V, N, or L; X102 is an A, E, S, D, or Q; X104 is a T, Q, or L; X106 is an L, R, or T; X107 is an R or L; X108 is an L, A, V, or T; X109 is a V, L, or I; X110 is a K, Y, S, I, V, T, or Q; X111 is an I or V; X112 is an N, D, E, or G; X113 is a D, G, N, or R; X114 is a W, T, V, E, D, S, or F; X115 is a T, V, N, P, F, M, or A; X116 is an E, A, I, T, F, or Q; X117 is I, Y, L, V, S, or T; X118 is a T, S, or A; X119 is a Q, D, or L; X120 is a F, I, or V; X121 is a I, M, L, or T; and X122 is a L, V, or F (FORMULA 2, SEQ ID NO: 745). In aspects, a gDP comprises a sequence according to the formula V--X2-X3-X4-X5-X6-X7-X8-X9-X10--$C_1$--X12-X13-X14-X15--L--X17-X18-X19-X20-X21-X22-X23-X24-X25-X26-X27-X28-X29-X30-X31-X32--Y--X34-X35-X36-X37-X38--W--X40-X41-X42-X43-X44-X45-X46--$C_2$--X48-X49-X50-X51-X52-X53-X54--E--Y--X57-X58--$C_3$--X60-X61-X62-X63-X64-X65--G--X67--$C_4$--X69-X70-X71-X72-X73-X74-X75--W--X77-X78-X79-X80-X81-X82-X83-X84-X85-X86-X87-X88--D--X90--L---G--X93-X94-X95-X96-X97--P--X99-X100-X101-X102--G--X104--Y--X106--R--X108-X109-X110-X111-X112-X113-X114-X115-X116-X117-X118-X119-X120-X121-X122, wherein $C_1$-$C_4$ are cysteines (but numbered for convenience of reference); X2 is Y, R, K; X3 is a Y or H; X4 an A, T, V, or L; X5 is a V, T, R, or I; X6 is an L, S, P, Y, or R; X7 is an E, A, L, T, D, M, or V; X8 is empty or any residue (S); X9 is an R, A, D, or E; X10 is an A, P, N, S, or G; X12 is an R, D, G, or S; X13 is an S, M, V, F; X14 is V, L, or A; X15 is an L, A, V, or E; X17 is an N, I, or W; X18 is an A, S, or P; X19 is a P, D, F, I, E, or N; X20 is an S, P, T, or G; X21 is an E, Q, D, or N; X22 is an A, V, P, or I; X23 is an P, G, D, V, K, or E; X24 is a Q, R, Y, A, S, or D; X25 is I, T, L, V, or M; X26 is V, L, or I; X27 is an R, W, N, L, or S; X28 is a G, E, S, T, or A; X29 is an A, L, Q, or I; X30 is any 0-6 residues; X31 is a P, V, S, L or Q; X32 is any 0-7 residues; X34 is an N, R, D, or E; X35 is an L or A; X36 is a T, H, L, or S; X37 is an I, V, or L, X38 is an A, I, S or V; X40 is F or Y; X41 is R, K, or V; X42 is M, I, T, L, or V; X43 is G, E, A, S, T, or I; X44 is G, S, D, R, K, Q, or D; X45 is an N, G, D, A, or M; X46 is 0-6 of any residues; X48 is an A, G, E, or T, or is absent; X49 is an I, R, H, Y, or is absent; X50 is a P or L; X51 is a I, L, or M; X52 is a T, Y, L, or F; X53 is a V, Y, F, L, or R; X54 is a M, I, R, or K; X57 is a T, A, Y, R, or F; X58 is an E, D, N, or L; X60 is a S, E, D, Q, or G; X61 is a Y, P, T, or D; X62 is an N, R, D, K, Q, or V; X63 is a K, Q, E, or R; X64 is a S, H, V, P, E, or L; X65 is an L or F; X67 is an A, Y, R, T, or E; X69 is a P, R, K, S, A, or L; X70 is an I, Y, R, V, L, M, or K; X71 is an R, K, S, or Q; X72 is a T, N or S, in one aspect T or S; X73 is a Q, P, T, L, or A; X74 is a P, G, S, D, or Q; X75 is an R, F, M, W, or Y; X77 is an N, D, W, S, L, K, or A; X78 is absent or is a S, T, R, E, P, or V; X79 is a Y, F, P, R, S, or D; X80 is a Y, L, or S; X81 is a D, A, V, or T; X82 is an S, G, M, K, or P; X83 is an F, Y, T, or S; X84 is an S, A, M, or T; X85 is an A, Y, F, or L; X86 is a V, P, T, I, or L; X87 is an S, T, or G; X88 is an E, D, or R; X90 is an N, E, or G; X93 is a F or L; X94 is an L, I, V, or T; X95 is a M, I, F, or L; X96 is a H, A, V, M, or F; X99 is an F, R, Q, P, or A; X100 is an E, L, F, or A; X101 is a T, V, N, or L; X102 is an A, E, S, D, or Q; X104 is a T, Q, or L; X106 is an L, R, or T; X108 is an L, A, V, or T; X109 is a V, L, or I; X110 is a K, Y, S, I, V, T, or Q; X111 is an I or V; X112 is an N, D, E, or G; X113 is a D, G, N, or R; X114 is a W, T, V, E, D, S, or F; X115 is a T, V, N, P, F, or A; X116 is an E, A, I, T, F, or Q; X117 is I, Y, L, V, S, or T; X118 is a T, S, or A; X119 is a Q, D, or L; X120 is a F, I, or V; X121 is a I, M, L, or T; and X122 is a L, V, or F (FORMULA 3, SEQ ID NO: 746).

In aspects a gDP comprises a sequence according to any of the preceding Formulas (1-3) and gD sequence further comprises a sequence downstream of X122 according to the formula Xa--$\underline{C_5}$--X(1)-X(2)-Xb-X(3)--$\underline{C_6}$, wherein Xa is any 6 to 8 residues; X(1) is Y or F; X(2) is A or S; Xb is any 7 to 11 residues; and X(3) is A, L, or W (FORMULA 4; SEQ ID NO: 747). In aspects, one or more of $C_1$ and $C_5$, $C_2$ and $C_6$, and $C_3$ and $C_4$ form cysteine-cysteine double bonds. In aspects, all of $C_1$ and $C_5$, $C_2$ and $C_6$, and $C_3$ and $C_4$ form cys-cys double bonds.

In aspects, gDPs comprise a sequence according to any of the above-described formulas and the gD sequence further comprises a sequence downstream of the Formula 4 sequence according to the formula: V--X(4)-V--X(5)-X(6)-X(7)--G--X(8)--L--X(9)--P--X(10)--F--Xc-X(11)--V--X(12)-X(13)-X(14)-Y, wherein X(4) is any residue, in one aspect an S or T; X(5) is any residue, in one aspect an I; X(8) is any residue, in one aspect an M or a V; X(9) is absent or any residue; X(10) is any 1-2 residues, in one aspect comprising an E or a P; Xc is any 4-8 residues; X(11) is any residue, in one aspect a T or a V; X(12) is any residue, in one aspect an A or an N; X(13) is any residue; in one aspect a V, L, or is absent; X(14) is any residue, in one aspect an L or a W or is absent (FORMULA 5, SEQ ID NO: 748). In aspects, the Formula 5 sequence has a sequence according to the formula: V--T--V--D--S--I--G--M--L--X(10)--P--R--F-X(14)--T--V--X(17)-X(18)-X(19)-Y (FORMULA 6, SEQ ID NO: 749). In aspects, the Formula 6 sequence further comprises a sequence according to the formula: S--Xd--G--V--T--V--D--S--I--G--M--L--X(9)--P--R--F--Xc--T--V-X(12)-X(13)-X(14)-Y, wherein Xd is any 5-6 residues (FORMULA 7, SEQ ID NO: 750). In aspects, the gD sequence further comprises a sequence downstream of the Formula 4 sequence according to the formula Xx-V-T-V-D-S-I-G-M-L-P--R-F-Xy-T-V-Xz-Y, wherein Xx is any 6-10 residues, in one aspect 9 residues; Xy is any 5-9 residues, in one aspect 6 residues; and Xz is any 0-4 residues, in one aspect 2 residues (FORMULA 8, SEQ ID NO: 751).

In aspects, the gDD sequence comprises a sequence upstream of the Formula 1, Formula 2, or Formula 3 sequence according to the formula: X.1-X.2-L-X.3-X.4--L--X(I)--V, wherein X.1 is any residue, in one aspect P or A; X.2 is any residue, in one aspect V or L; X.3 is any residue, in one aspect D or A; X.4 is any residue, in one aspect G or A; and X(I) is any about 7-9 residues (FORMULA 9, SEQ ID NO: 752). In aspects, the Formula 9 sequence comprises a sequence according to the formula: P--X.2--L--X.3--G--X.4--L--X(I)--V--Y--H (FORMULA 10, SEQ ID NO: 753). In aspects, the Formula 9 sequence comprises a sequence according to the formula: X.1-X.2--L--X.3-X.4--L--X(I)--V--X(II)--P--X.5--F--X.6--P--P--X.7-X.8--P--X.9--T, wherein X(II) is any 4-10 residues, X.5 is any residue or is absent, in one aspect T or is absent; X.6 is any residue, in one aspect Q or P; X.7 is any residue, in one aspect S or A; X.8 is any residue, in one aspect L or Y; and X.9 is any residue, in one aspect I or Y (FORMULA 11, SEQ ID NO: 754).

In aspects, a gDP comprise a sequence according to any of Formulas 1-3 further comprises a sequence upstream of the Formula 1, Formula 2, or Formula 3 sequence according to the formula: P-X-L-X-R-X-X-X-X-X-X-X-X-R-V-Y-H, wherein X can be any residue (FORMULA 12, SEQ ID NO: 755).

Features of this section overlap with the description of other sections below, particularly the core domain and N-terminal and C-terminal extensions thereof. In aspects, the N-terminal extension region of a core domain is materially, mostly, generally, or at least substantially composed of flexible AAs. Additional aspects relating to N1BDs, variants, and related methods and principles adapatable to such aspects are described in, e.g., Manoj S et al. Proc Natl Acad Sci USA. 2004; 101(34):12414-12421. doi:10.1073/pnas.0404211101; Martinez W M et al. J Virol. 2002; 76(14):7255-7262. doi:10.1128/jvi.76.14.7255-7262.2002; and Alves Dummer L et al. Vet Res. 2014; 45(1):111. doi:10.1186/s13567-014-0111-x.

As described above with respect to HVEMBD gDPs, N1BD gDPs can comprise "deletions" (truncations/omissions), substitutions, or both, of gDSs/AAs downstream of the N1BD. In aspects, such omissions/deletions or substitutions DOS enhance Nectin-1 binding of the gDP. In aspects, substitutions are made in AAs corresponding to AA 150, 151, 176, or 302 of HSV-1 gD. In aspects, gDP(s), such as N1BD, HVEMBD, or HVEMBD+N1BD gDP(s) lack AAs corresponding to AAs 305-325, 310-325, 305-335, 310-335, 305-340, 310-340, 305-361, 310-361, 305-394, or 310-394 of HSV-1 gD or corresponding AAs from a homolog related to gDS(s) of the gDP, such as a N1BD. In aspects, gDP(s) lack W319, either through substitution or deletion. In aspects, such gDP(s) exhibit DOS better affinity for receptor(s). In aspects, gDP(s) comprise a gDS corresponding to HSV-1 AAs 260-305, 280-305, or 285-305, but lack an AARS corresponding to AAs 310-335, 310-360, or 310-394.

In aspects, CEPs comprise gDP(s) comprising an N1BD that DOS competes with a TR Nectin-1 for binding to WT Nectin-1 (and DOS prevents Nectin-1:Nectin 1 dimer formation in some cases). In aspects, gDP(s) exhibit DOS better affinity for Nectin-1 than WT Necting-1. In aspects, gDP(s) exhibit at least 2×, 3×, 4×, 5×, or at least 10×, e.g., at least 20×, at least 30×, at least 50×, or at least 100× or higher affinity for Nectin-1 than Nectin-1.

In aspects, gDP(s) exhibit a $K_d$ for Nectin-1 of at least 10 nM, at least 15 nM, at least 20 nM, or at least 25 nM. In aspects, gDPs exhibit a $K_d$ for Nectin-1 of at least 50 nM, e.g., at least 100 nM, at least 120 nM (e.g., 110 nM-360 nM), at least 150 nM, at least 175 nM, at least 190 nM, at least 200 nM (e.g., at least 250 nM, at least 275 nM, at least 300 nM, at least 330 nM, at least 350 nM, at least 380 nM, or at least 400 nM), such as 15-450 nM, 15-300 nM, 15-350 nM, 30-390 nM, 50-350 nM, 100-350 nM, or 20-400 nM).

In aspects, gDP(s) exhibit a Nectin-1 $K_{on}$ of at least $1.\times10^5$ $M^{-1}s^{-1}$, $1.25\times10^5$ $M^{-1}s^{-1}$, $1.5\times10^5$ $M^{-1}s^{-1}$, $2\times10^5$ $M^{-1}s^{-1}$, $2.5\times10^5$ $M^{-1}s^{-1}$, $3\times10^5$ $M^{-1}s^{-1}$, $4\times10^5$ $M^{-1}s^{-1}$, $5 \times 10^5$ M$^{-1}$s$^{-1}$, or even at least $7 \times 10^5$ M$^{-1}$s$^{-1}$) (e.g., 1-10, 1.2-8.8, 1.5-7.5, 2-8, or 2-10$\times 10^5$ M$^{-1}$s$^{-1}$-1.25$\times 10^5$ M$^{-1}$s$^{-1}$). In aspects, gDP(s) exhibit a Nectin-1 K$_{off}$ of at least 0.5, 0.7, 1, 1.1, 1.25, 1.5, or 2 (e.g., 0.5-3, 0.5-2.5, 0.7-3.5, 0.7-2.8, 1-4, 1-3, or 1-25)$\times 10^{-2}$ s$^{-1}$, 1.17$\times 10^{-2}$ s$^{-1}$. In aspects, gDPs exhibit at least 1.5×, at least 2×, at least 2.5×, or at least 3× enhanced K$_d$, K$_{off}$, or K$_{on}$ values as compared to WT gD(s), such as HSV-1 gD, HSV-2 gD, or PRV gD. Methods for assessing such values and relevant modifications of PRV gD that can be adapted to such AOTI are provided in Li A et al. PLoS Pathog. 2017; 13(5):e1006314 Other modifications to gDS(s), methods for evaluating such modifications, and related compositions/methods adaptable to AOTI are described in Milne R S et al J Virol. 2003; 77(16):8962-8972; Taylor J M et al. Cell Host Microbe. 2007; 2(1):19-28; Karasneh G A et al. *Virol J.* 2011; 8:481; and U.S. Pat. No. 5,814,486; and Di Giovine P et al. PLoS Pathog. 2011; 7(9):e1002277.

In AOTI, gDP(s) comprise N1BD(s), HVEMBD(s), or CT, which exhibit suitable, comparable, or improved affinity characteristics (K$_d$, K$_{off}$, or K$_{on}$ values) for N1s, HVEMs, or CT, of ≥2 species (e.g., swine N1 and human N1) as compared some, most, or all (SMOA) of the gDs of a-HVs that typically infect some, most, most, or all (SMOA) of such TRs. E.g., in aspects, gDPs of CEPs exhibit better affinity for human N1, swine N1, or both, as compared to HSV-1 gD, HSV-2 gD, PRV gD, or a combination thereof. In aspects, gDP(s) exhibit affinity characteristics that are suitable, comparable, or improved with respect to at least two or more types of N1s of different TR species as compared to the gDs of a-HVs that typically infect such TRs. E.g., gDP(s) can exhibit at least suitable or at least comparable binding to swine N1 & human N1 WRT to HSV-1 gD & PRV gD, respectively.

3) Nectin-2 RBD

In AOTI, gDP(s) comprise a Nectin-2 (N2) RBD (N2RBD). In aspects, gDP(s) comprise a WT N2RBD. In AOTI, gDP(s) comprise a variant of a non-N2-binding gD (e.g., a variant of HSV-1 gD) that is modified to be able to at least adequately bind N2. E.g., in aspects, gDP(s) comprise a gDS comprising generally all or most of the C-terminal portion of the HSV-1 gD HVEMBD (but not necessarily enough to comparably or adequately bind HVEM), the overlapping domain, and the N1BD but that include a substitution at position L50, L53, Q52, or combinations in the overlapping domain (e.g., Q52R, Q52P, or Q52A; L50P; or L53A). In AOTI, gDP(s) comprising a N2BD comprise an AARS RVRHRSIOI/SVSHSOCE to AAs 32-57 of HSV-1 gD or HSV-2 gD.

In aspects, such gDP(s) adequately, comparably, or improvingly bind both N2 and N1, but not HVEM (e.g., a Q52 variant); N2 and HVEM; N1, N2, and HVEM (e.g., a L53 variant); or only N2. In aspects, such gDP(s) adequately, comparably, or improvingly bind 30SH. In aspects, gDP(s) that bind N2 do not bind 30SHS. In aspects, gDP(s) comprising a N2BD also suitably or at least comparably bind 30SHS. As DEH, in aspects variants gDD(s), such as N1BD, N2BD, HVEMBD, or combinations that comprise gDSV(s) exhibit structural similarity to corresponding/counterpart gDD(s). E.g., a substitution at L50 comprises a geometrically constrained AA, such as a Pro, versus a more flexible AA, such as a Gly or Ala, which may be required to maintain sufficient structure of an N2BD to permit at least suitable N2 binding. In aspects, gDP(s) comprise an N2BD that binds to N2 PPTs of two or more species (e.g., mice and humans). Aspects of N2BDs, including variants, that can be adapted to such AOTIs are described in Connoly et al., 2003, supra and Landsburg D J et al. J Virol. 2003; 77(14):8127-8140.

In aspects, OSMGAOA gDP(s) of CEPs lack any N2BD that DOS (1) enhance immune system NKC downregulation/evasion (e.g., decrease NKC degranulation, lysis, or both of DCA-cells), (2) impair DNAM-1 binding, or (3) degrade endogenous N2. Effects of gDP(s) on such functions in NKCs are described in, e.g., Grauwet K et al., PNAS 2014, 111 (45) 16118-16123; DOI: 10.1073/pnas.1409485111. In aspects, OSMGAOA gDP(s) lack WT N2BD(s). In aspects, OSMGAOA gDP(s) lack any N2BD(s).

4) Other gD RBDs/Receptor Binding Characteristics

In aspects, gDP(s) comprise RBD(s) that DOS bind to gDR(s) besides N1, N2, and HVEM. In aspects, such gDR(s) comprise 30SHS, a MHC gDR, or a nectin family gDR other than N1 or N2. In aspects, gDP(s) bind two or more of such alternative gDR(s). In aspects, such gDP(s) also bind one, two, or all of N1, N2, and HVEM. In aspects, such alternative gDR-binding gDP(s) bind less than all, only one, or none of N1, N2, and HVEM.

In aspects, gDP(s) bind 30SHS. In aspects, gdP(s) bind 30SHS suitably, comparably, or better than HSV-1 gD. In aspects, gDP(s) bind both 30SHS and N1. In aspects, gDP(s) bind N1, but not 30SHS. In aspects, gDP(s) bind 30SHS and comprise a gDRBD for the gDR that is RVRHRSIOI/SVSHSOCE to HSV-1 gD AAs 26-57. In aspects, gDP(s) that bind 30SHS comprise a gDS that is RVRHRSIOI/SVSHSOCE to HSV-1 gD AAs 26-285, 26-340, or 26-265. In aspects, such a gDS retains AAs corresponding to at least half MGAOA of K26, R60, R61, R155, K147, and K215 of HSV-1 gD. In aspects, gDP(s) bind 30SHS with DOS greater affinity characteristics than HSV-1 gD. In aspects, such gDP(s) comprise substitutions at two or three of AAs corresponding to AAs D240, R247, and F248 of HSV-1 gD. Aspects of gD interactions with 30SHS adaptable to AOTI are described in Yoon M et al. J Virol. 2003; 77(17):9221-9231.

In aspects, a gDP exhibits reduced binding of 30SHS and comprises substitutions or deletions at 1+ AAs corresponding to HSV-1 gD AAs L50, L53, Q52, or combinations, which result in such reduced 30SHS binding.

In aspects, gDP(s) exhibit a K$_d$ for 30SHS of less than about 1 x 10$^{-6}$ M, such as less than about 0.1$\times 10^{-7}$ M or less than about 1$\times 10^{-8}$ M. In aspects, gDP(s) exhibit a Kd for 30SHS of about 0.5-9.5$\times 10^{-6}$ M. In aspects, gDP(s) exhibit a K$_d$ for 30SHS that is at least about 1$\times 10^{-5}$ M, such as at least 5$\times 10^{-5}$M or at least 1$\times 10^{-4}$M.

d. Ectodomain Core AARSs

In aspects, gDP(s) comprise a gDD that corresponds to MGAOA of a WT gD core domain. In aspects, a core domain exhibits RBD functionality, e.g., is a N1BD or N2BD. In aspects, gDP(s) comprise a core domain (gDCD) that comprise a portion that DOS enhances the functioning of RBD(s). In still other aspects, gDCD(s) primary function comprises or is to maintain the spatial relationship of other domains (e.g., an HVEMBD and a partial or total PFD).

Typically, gDCDs comprise an immunoglobulin (Ig)-like V-fold structure (e.g., in a sequence corresponding to HSV-1 gD AAs ~80-210) (an "IgV domain" or IgVD). Typically, gDCDs also comprise an N-terminal flanking domain (CDNTFD) (corresponding to HSV-1 gD AAs ~59-79 or a FV, FF, or homolog thereof); C-terminal flanking domain (CDCTFD) (corresponding to HSV-1 gD AAs ~211-280 or a FV, FF, or homolog thereof); or both such flanking domains. Such structures are common to a-HV gDs. E.g., PRV gD exhibits such a structure, as does HSV-1 gD and HSV-2 gD.

In aspects, gDCD(s), such as variants of a gDCD, have structural elements or a local or global structure that is similar to WT gDCD(s). In aspects the gDCD comprises MGASAOA of the six cysteine residues that form three cysteine bonds in many WT gDs, including HSV gDs (e.g., cys residues corresponding to HSV-1 gD AAs and disulfide bonds cys91: cys214, cys131 cys227, and cys143: cys152). In aspects, the position of each such corresponding cys residue in a gDD differs by less than about 20 residues, 15 residues, 10 residues, 8 residues, or 5 residues (e.g., 0-3 residues, 0-5 AAs, 0-7 residues, 0-10 residues, 0-12 AAs, 0-16 AAs, or 0-25 residues) WRT the corresponding position of such cys residues in a related WT gD when aligned.

In aspects, the IgVD comprises a nine-stranded central β-barrel structure. In aspects, the IgVD comprises a kinked, e.g., middle-kinked C" strand, in aspects leading to two strand halves connected with a distorted loop. In aspects, the gDCD contains two α-helices (α1 and α1'), located between strands C" and D or between the BC and the C"D strands of the gDCD. In aspects, a CDCTFD comprises an additional α2' helix. In aspects, a CDCTFD lacks any additional alpha helix.

In AOTI, a gDD variant sequence comprising a gDCD and optionally related N-terminal or C-terminal extensions will exhibit or be predicted to comprise an IgV domain through empirical structural analysis (e.g., crystallography methods), computer-aided sequence analysis, or both. In aspects, gDV(s) differ from WT gDS(s) when structurally aligned by r.m.s. deviations of between ~0.1 and 0.9 (e.g., 0.3-0.9), 0.1 and 0.75, or 0.1-0.5 Å in SMGASAOA of the compared gDD(s). Empirical determination and characterization of gDDs is described in e.g., Carfi A et al. Mol Cell 8: 169-179; Guangwen Lu et al, Journal of Virology October 2014, 88 (23) 13678-13688; DOI: 10.1128/JVI.01906-14; Krummenacher C et al (2005). EMBO J 24: 4144-4153; and other references DEH. Additional relevant methods also are DEH.

In aspects, gDP(s) comprise a gDCD-like sequence that when analyzed by computational sequence structure analysis, such as by PFAM/Interpro Scan analysis, is identified as being associated with an immunoglobulin-like domain superfamily sequence (e.g., InterPro entry IPR36179) with an E-value that indicates the structure is likely present, very likely present, highly likely present, or almost certainly present in the variant. In aspects, gDP(s) comprise a variant gDCD that is identified as exhibiting a Herpesvirus glycoprotein D/GG/GX domain family using a tool trained to identify the presence of this domain in a sequence, such as the NCBI Conserved Domain Database ("CDD"), Interpro Scan/PFAM, Motif Scan, or the EMBL Xfam sequence search tool. In AOTI, the variant will exhibit an E-value, bit score, or both, which indicates that the presence of such a domain in the variant is likely, very likely, highly likely, or almost certain. For example, an E-value>10e-100 will typically indicate near certainty of the relationship; 10e-30<E-value<10e-100 indicates the relationship is highly likely; 10e-10<E-value<10e-30 indicates that the relationship is very likely; and at 10e-6<E-value<10e-10 the relationship can be considered likely. A portion of HSV-1 gD (residues 82-206), for example, exhibits an E-value of 1.72 e-45 with respect to its relationship to pfam01537 and HSV-2 exhibits an E-value of 8.0e-39 with respect to its relationship to pfam01537. Suitable variants in one aspect are characterized as variants that when analyzed are at least likely, very likely, or at least highly likely to contain a version of this domain structure.

In aspects, a variant gDCD comprises less than 5, less than 4, less than 3, or 1-2 insertions in the IgVD or overall gDCD. In aspects, a variant gDCD comprises no insertions WRT a WT IgVD or a WT gDCD. In aspects, SMGASAOA of any insertion(s) in a variant gDCD in the IgVd are 20 AAs or less, 15 AAs or less, 12 AAs or less, 10 AAs or less, 7 AAs or less, or 5AAs or less in size (e.g., 1-4 AAs or 1-3 AAs).

In aspects, gDP(s) lack any strand(s) that diminish binding to OSMOA gDR(s). E.g., in aspects gDP(s) comprise gDCDs RVRHROSI to BHV-1 gD, but which lack the nectin-1-binding diminishing G-strand/a2-helix interloop of BHV-1 gD. In aspects, such a gDP comprises a substitution of mature BHV-1 gD R188 (e.g., with Gly). In aspects, such gDP(s) exhibit at least 2×, at least 3×, or at least 4× affinity for N1. Such approaches are exemplified by Yue D, et al. Science Advances. 2020: Vol. 6, no. 20.

In aspects, as DEH, a CDCTFD or a gDS corresponding to a gDS in a WT gD positioned downstream of the CDCTFD comprises 1+ insertion(s). In aspects a CDCTFD or downstream gDS comprises a single insertion. In aspects, the length of such insertion(s) total 15-350 AAs, 20-300 AAs, 25-250 AAs, 30-180 AAs, 30-150 AAs, 40-240 AAs, 40-200 AAs, 50-250 AAs, or 50-200 AAs. In aspects, MGASAOA of such insertion(s) comprise Ag(s). In aspects, such Ag(s) are associated with PTPS(s), FL(s), MSL(s), SCS(s), or combinations. In aspects, AARSs inserted in the IgVD or near the IgVD (e.g., within 25 AAs, 15AAs, or 10 AAs of either or both ends) are mostly, generally, or substantially only composed of rigid residues. In aspects, insertion of residues in the C-terminal portion of a CDCTFD or downstream thereof (e.g., in a PFD or downstream of a PFD) are mostly, generally, or substantially composed of flexible residues.

e. Profusion & Secretion-Promoting Domains & Related Subdomains

As DEH, in aspects gDP(s) comprise a gD profusion domain (e.g., a domain that corresponds to a PFD of a WT a-HV, such as PRV or a HSV). In HSV-1 gD, the WT PFD is located in/about AAs 286-330. SFE Cocchi F et al. PNAS. 2004; 101(19):7445-7450.

In AOTI, gDP(s) comprise a flexible hinge domain, which corresponds to the AARS upstream of the PFD and the N-terminal portion of the PFD in HSV-1 gD (AAs 281-292). In aspects, a portion of the PFD associates an overlapping domain, if present in the gDP, in the gDR-unbound state (similar to how AAs 293-331 of HSV-1 gD turn and partially run anti-parallel (e.g., at about AAs 311/315-331) to HSV-1 gD AAs 48-57/58). In AOTI, such gDP(s) comprise a functioning PFD. In AOTI, gDP(s) lack a functioning PFD.

In aspects, the PFD in a gDP is proline-rich, comprising at least 5%, at least 10%, at least 15%, or at least 20% Pro residue content. In aspects, residues corresponding to most or all of HSV-1 gD P291, P292, and W319 are maintained in a functioning PFD. In aspects, AAs corresponding to MGASAOA of HSV-1 gD AAs Phe248, Asn252, Thr255, Val256, Tyr259, Ile315, Asn318, and His320 are maintained.

In aspects, gDP(s) lack the C-terminal portion of a PFD. E.g., in aspects, no sequence corresponding to AAs 300-340, e.g., 300-335, 302-335, 302-340, 305-335, or 305-340 are contained in the sequence. In aspects in which gDP(s) lack TMD(s) and cytosolic domains such gDP(s) lack any gDS(s) that corresponding to any such downstream gDS(s).

In aspects, gDP(s) comprise an AA corresponding to W319 that is in a similar position in the gDP with respect to a residue corresponding to F154 of an N1BD, such residues DOS promoting N1 binding. In aspects, gDPs comprise a sequence according to the formula P-$X_1$-$X_2$-W-$X_\mu$-P-S-$X_3$-$X_4$-$X_\Omega$-$X_5$-$X_6$-P-$X_7$-$X_8$-$X_9$-P-A-T-P (SEQ ID NO:720), wherein $X_1$ is any residue, in aspects P; $X_2$ is N or G; $X_\mu$ is 0-2 of any residues, in aspects H-I; $X_3$ is I or L; $X_4$ is Q or E; $X_\Omega$ is any 2 residues; $X_5$ is A or T; $X_6$ is any residue, in aspects T; $X_7$ is any residue, in aspects Y or P; $X_8$ is any residue, in aspects H or P; and $X_9$ is any residue, in aspects P or according to the formula P-X$\alpha$-A-P-$X_\beta$-$X_2$-P-$X_3$-$X_4$-W-$X_5$-$X_6$-P-$X_7$-$X_A$-P (SEQ ID NO:721), wherein X$\alpha$ is any ~4 AAs, $X_\beta$ is any 2-3 AAs, $X_2$ is I or V; $X_3$ is any residue, in some aspects P; $X_4$ is N or G; $X_5$ is any residue, in aspects H or P; $X_6$ is any AA, in aspects I or Q; $X_7$ is S or A; and $X_A$ is ~9 AAs comprising 1-4 P AAs. In AOTI such a gD comprises GAOA of SEQ ID NO:722.

In aspects, gDP(s) lack a PFD. In aspects, such gDP(s) exhibit enhanced gDR binding for one or more gDR(s) (e.g., N1, HVEM, or both). In aspects, such gDP(s) exhibit at least 5×, at least 10×, at least 15×, at least 20×, at least 35×, at least 50×, or at least 80× gDR affinity than corresponding gDP(s) comprising a PFD.

In AOTI, gDP(s) comprise a PFD but lack any RBD(s). In AOTI, gDP(s) comprise a PFD but lack any IgVD or any gDCD. In AOTI, an immature gDP comprises a gDSS and a PFD. In aspects, such a gDP comprises 1, 2, or 2+ ETSs, e.g., a DEC-205-binding ETS (e.g., a keratin DEC-205 binding AARS).

Additional aspects relating to PFD modifications, deletions, etc., that can be adapted to such AOTI are described in Li A et al. PLoS Pathog. 2017; 13(5):e1006314.

f. Secretion-Promotion gDD (SPD) & GPI Anchoring gDD (GPIAD)

Portions of WT gDCDs can exhibit additional functional characteristics and gDS(s) corresponding to such functional domains can be included in gDCDs or can be separately incorporated into gDP(s). In aspects, gDP(s) comprise a functional glycosylphosphotidylinositol (GPI) anchoring domain (GPIAD). In aspects, gDP(s) that comprise a GPIAD DOS associate with cell surface membranes, even when such gDP(s) lack TMD(s). In aspects, such gDP(s) are DOS more processed by ERs in COEs, e.g., in GPI-deficient cells. In aspects, such a gDS corresponds to residues 234-337 of HSV-1 gD (described in Beghdadi-Rais et al., J. Cell Sci. 105:831-40. 1993) (e.g., a gDP can comprise a variant that is RVRHROSI/SVSHSOCE to such sequence). In aspects, gDP(s) comprise a sequence corresponding to HSV-1 gD AAs 254-294 (in aspects all of 234-254), which can act as a secretion promoting domain (SPD) in suitable gDP(s) that DOS enhances secretion of the gDP from COE (e.g., gDP(s) can comprise a gDS that is RVRHROSI/SVSHSOCE to such a sequence). In aspects, glycosylation site(s) are removed from such a gDS resulting in further DOS enhanced secretion. Additional aspects relating to such gDS(s) that can be adapted to AOTI are described in US20030236396.

g. gD TMD & Cytosolic Domain Characteristics

As DEH, in aspects gDP(s) comprise TMDs, cytoplasmic domain (a.k.a. an intravirion/topological domain), or both. In aspects, gDP(s) lack any TMD, topological domain, or both. E.g., in gDP(s) that are FFs or FVs of HSV-1 gD, such gDP(s) can lack any gDS corresponding to HSV-1 gD AAs 331-394, 335-394, 340-394, or 344-394. In MDV gD FFs or FVs such a gDP can lack any gDS corresponding to MDV/SuAHV-1 gD AAs 358-378 or any residue downstream of residue 358. In PRV gD FFs or FVs, such a gDP can lack any gDS corresponding to PRV gD AAs 358-378 or any residue downstream of AA 358. Such gDP(s) lacking a TMD can be described as "soluble" gD(s). Additional examples of such gDP(s) and related principles/methods described in, e.g., Fusco D et al. PNAS. 2005; 102(26):9323-9328.

3. EAT-2 PPTs

In aspects, CEPs comprise Ewing's sarcoma-associated transcript 2 ("EAT-2") PPTs. In aspects, EAT-2 PPTs are FPs. In aspects, EAT-2 PPTs are NFPs. In aspects, EAT-2 PPTS comprise ELWT EAT-2 AARSs. In aspects, EAT-2 PPTS comprise an FF of a EL WT PPT. In aspects, EAT-2 PPTs comprise a chimeric EAT-2 PPT. In aspects, EAT-2 PPTs comprise FVs of EAT-2 PPTs. CEPs can comprise any suitable number of EAT-2 PPTs of any suitable type.

In AOTI, EAT-2 PPT(s) DOS induce IR(s), CE(s), or both in TRs. In aspects, EAT-2 PPTs of CEPs DOS link SLAM family ICR(s) to phospholipase Cy, calcium fluxes, Erk kinase, or combinations. In aspects, an EAT-2-containing CEP accelerates NKC-mediated IR(s), B cell mediated IR(s), NKT cell mediated IR(s), DC-mediated IR(s), T cell-mediate IR(s), macrophage IR(s), or CT.

In aspects, EAT-2 PPT CEPs DOS induce polarization and exocytosis of cytotoxic granules from IC(s), such as NKCs, CD8 T-cells, or both. In aspects, EAT-2 PPT CEPs DOS induce DC maturation, monocyte phagocytosis of DCA-associated cells, or both. In aspects, EAT-2 PPT CEPs DOS reduce CRACC/SLAMF7 IR inhibition.

In aspects, EAT-2 PPTs in CEPs DOS enhance one or more aspects of immunological memory, such as enhanced memory T cell population or enhanced memory T cell IR(s). In aspects, EAT-2 PPT CEPs DOS break IC tolerance characteristic(s).

In aspects, EAT-2 PPT CEPs DOS modulate Th1-biasing proinflammatory cytokine and chemokine responses in TRs.

In aspects such IR(s) comprise DOS increases in IC expression of IL-1α, IL-2, G-CSF, IL-5, IL-12p70, GM-CSF, IL-1β, TNFα, IL-12p40, IL-6, IL-9, RANTES, MCP-1, MIP-1α, MIP-1β, IFN-γ, or combinations. In aspects, EAT-2 CEPs enhance IL-1β production 2×, 3×, 4×, or more; enhance IL-6 production 3×, 4×, 5×, or more; enhance TNFα 2×, 3×, 5× or more; enhance G-CSF production 3×, 4×, 5×, or more; enhance IL-17 production 33%+, 50%+, or 75%+; enhance IL-10 production 1×, 1.5×, 2×, or more; or exhibit combinations thereof.

In aspects, CEPs comprising EAT-2 PPT(s) comprise pathogen DCA-associated Ag(s), such as VAg(s). In aspects, EAT-2 CEPs comprise CAg(s) and the CEPs DOS inhibit tumor growth in TRs, reduce tumor size in TRs, or increase tumor necrotic tissue in TRs.

Aspects of WT functions of EAT-2 in such respects are described in, e.g., Aldhamen Y A et al. Vaccine. 2016; 34(27):3109-3118; Thompson A D et al. Oncogene. 1996 December; 13(12):2649-2658; Aldhamen Y A et al. J Immunol. 2012; 189(3):1349-1359; Pérez-Quintero L A et al. J Exp Med. 2014; 211(4):727-742; Aldhamen Y A et al. J Immunol. 2011; 186(2):722-732; Aldhamen Y A et al. Cancer Gene Ther. 2013; 20(10):564-575; Aldhamen Y A et al. Int Immunol. 2014; 26(5):291-303. doi:10.1093/intimm/ dxt061; and WO2011133870 (aspects of the '870 WO application relating to other SLAM Family ICR STAPs, such as SAP PPTs, also can be adapted to other AOTI DEH).

In aspects, an EAT-2 PPT is a human EAT-2 (SEQ ID NO:17), a murine EAT-2 PPT (SEQ ID NO:), or an FF or FV of either thereof. Additional EAT-2 encoding sequences and AARSs are known (see, GenBank Access Nos./NCBI protein database entries NM_012009.4, NM_012009, 148747582, NM_012009.5, 54792745, NM_053282.4 and Uniprot Entries 014796 and 035324). In aspects, an EAT-2 PPT is a canine EAT-2 or an FF or FV. In aspects, an EAT-2 PPT is a chicken EAT-2 PPT or a FF or FV thereof (SFE GenBank NM_001278073.1). In aspects, an EAT-2 PPT is a bovine EAT-2 PPT or an FF or FV thereof (see GenBank NM_001193162.1).

In aspects, an EAT-2 PPT, such as an EAT-2 variant, which comprises an AARS comprising generally all, substantially all, or all of a sequence according to the formula M-D-L-P-Y-Y-H-G-Xα-L-T-K-X1-X2-C-E-X3-L-L-L-K-Xα-G-V-D-G-N-F-L-X4-R-D-S-E-S-X5-P-G-X6-L-C-L-C-V-S-F-K-X7-X8-V-Y-X9-Y-R-I-F-R-E-K-H-G-Y-Y-R-I-Q-T-Xα-Xα-Xα-X10-P-X11-Xα-X12-F-P-X13-L-X14-E-L-X15-S-K-X16-Xα-K-P-X17-Q-G-X18-V-V-H-L-Xα-X19-P-I-Xα-R-X20-X21-Xα-Xα-Xα-R-Xα-R-G-X22-X23-L-E-L-X24-X25-X26-Xα-N-X27-X28-Xα-X29-Y-V-D-V-L-P (SEQ ID NO: 723), wherein Xα represents any AA, X1 is Q or R; X2 is D or E; X3 is T or A; X4 is L or I; X5 is I or V; X6 is V or A; X7 is N or K; X8 is I or L; X9 is T or S; X10 is S or T; X11 is K or R; X12 is V or I; X13 is S or N; X14 is K or Q; X15 is I or V; X16 is F or Y; X17 is N or G; X18 is M or L; X19 is K or N; X20 is T or N; X21 is S or N; X22 is L or M; X23 is K or E; X24 is E or N; X25 is T or V; X26 is F or Y; X27 is S or T; X28 is N or D; and X29 is D or E and which suitably, comparably, or improvingly exhibits any one or more EAT-2 function(s), such as the functions of EAT-2 PPTs described above.

In aspects, CEPs comprising EAT-2 PPT(s) also comprise a SLAMF CPCR PPT, e.g., a SLAMF5 CPCR PPT or a SLAMF7 CPCR PPT. In methods, a SLAMF CPCR is expressed in AAW delivery of CEPESC(s) including EAT-2-ES(s). In aspects, CEPs comprise both EAT-2 PPT(s) and SAP PPT(s). In aspects, CEPs comprise EAT-2 PPT(s), SAP PPT(s), and SLAMF6 CPCR PPT(s), which DOS enhance NKC activation. In aspects, CEPs comprise activating peptidic ligand(s) for a SLAMF receptor in addition to EAT-2 PPTs.

In aspects, EAT-2 AARS(s) are included in a gDFP. In aspects, EAT-2 AARS(s) are included in gDAgFP(s). In aspects, EAT-2 AARS(s) are expressed from different NAM(s) than the NAM encoding any gDP in the CEP.

4. C. Vectors

The constructs of the invention are typically incorporated into a larger construct that includes nucleotide sequences that (1) allow for stable replication of the combined construct, (2) aids in transmission of the construct to a host, (3) aids in the expression of a coding sequence or an expression cassette, or (4) a combination of any or all thereof. Such larger constructs are known in the art as "vectors" and where they are expressible are called "expression vectors." In general, a "vector" is a composition of matter which comprises one or more nucleotide sequences and which can be used to deliver the nucleotide sequences to the interior of a cell. Numerous vectors are known in the art including, but not limited to, linear polynucleotides, polynucleotides associated with ionic or amphiphilic compounds, plasmids, and viruses.

In general, any method described herein as relating to the delivery of nucleic acid molecules or nucleotide sequences can be performed by delivery of a suitable vector and any method or composition described herein as comprising a vector can comprise any suitable type of vector, except where the disclosure is specifically limited (e.g., in certain aspects of the invention the use of nucleic acid vectors, such as DNA plasmids, is specifically contemplated). Additionally, unless otherwise indicated herein any description of a "vector" can be construed as including or being an expression vector.

To illustrate, a construct, such as those described above, encoding, e.g., a gD:antigen sequence, can be combined with any suitable vector-forming nucleic acid construct (which, in the case of DNA vectors, may be described as a "backbone"), which vector construct can include any suitable collection of other nucleotide sequences (e.g., an origin of replication, a sequence encoding a selectable marker, one or more suitable sites for construct insertion, such as one or more multiple cloning sites, or a combination of any or all thereof), and the resulting expression vector can be a component of a composition of the invention or used in the methods of the invention. An "origin of replication" or "replication origin" is a sequence at which replication is initiated. Origins of replication are found in prokaryotes and eukaryotes and are required for the propagation of the plasmid episomally (i.e., extragenomically) in host cells.

Skilled practitioners reading this disclosure will understand that is overlap between what can be classified as a "vector" and what can be classified as an expression cassette, particularly in the case of non-viral DNA vectors (sometimes referred to as "DNA vectors" or "DNA vaccines"), such as plasmid vectors (sometimes "plasmids").

Expression vectors (sometimes also called "delivery vectors"), other vectors, and methods for their construction are known to those skilled in the art (SFE Ausubel et al., cited herein). Examples of suitable delivery/expression vectors include, e.g., a bacterial delivery vector, a DNA vaccine delivery vector, an RNA vaccine delivery vector, a virus delivery vector, a virus-like particle, or a composition that comprises such a vector in combination with other delivery-enhancing materials, such as a liposomal delivery vector, a transformed cell (e.g., a eukaryotic cell such as a producer cell or a DC or an attenuated bacteria) comprising a number of nucleic acid vectors, or a nucleic acid-loaded nanoparticle. In one embodiment, a delivery vector differs from a plasmid or phage vector. In aspects, a delivery vector and a plasmid or phage vector of this disclosure are the same.

In general, a vector in the context of this disclosure can comprise any suitable set of components. Examples of components that can be suitable contained in vectors of the invention include elements such as promoters and enhancers, typically where such elements are not associated with the coding sequence already in an expression cassette, and, thus, form an expression cassette once the coding sequence(s) are inserted into the vector. The properties associated with promoters/enhancers are discussed more thoroughly above; examples of which include tissue/cell specificity in some cases, detectably or significantly improved levels of expression of associated coding sequences, and detectably or significantly prolonged periods or frequency of expression of associated coding sequences. A vector also or alternatively can similarly comprise regulatory elements such as a polyA signal sequence, which typically will be positioned 3' of any inserted coding sequence(s). The properties of polyA sequences and similar elements also are discussed above. Depending on the vector, inserted sequences comprising coding sequences, and host utilized, if relevant, any of a number of suitable transcription and translation control elements, including constitutive and inducible promoters, transcription enhancer elements, transcription terminators, etc. may be incorporated into an expression vector (see e.g., Bitter et al. (1987) Methods in Enzymology, 153:516-544, which exemplifies relevant PMCs.

The vector backbone will typically include sequences that sustain expression activity, such as transcription factor binding sites. Minimally sized vectors, such as "minicircles," which are known in the art, can be associated with relatively lower immunogenicity than larger vectors. In AOTI, a vector of a composition or method of the invention may be a self-replicating vector, which is capable of being maintained in dividing mammalian cells. Examples of self-replicating vectors are plasmids including latent on (oriP) elements and EBV nuclear antigen 1 (EBNA1) gene derived from the Epstein Bar Virus (EBV). Such vectors are described in, e.g., Längle-Rouault F et al. J Virol. 1998; 72(7):6181-6185. In aspects, a vector of a composition or method of the invention may be a self-partitioning vector. Self-partitioning vectors include self-partitioning plasmids containing scaffold/matrix attachment regions (S/MARs), which optionally can include a suitable replication origin, e.g., a SV40 virus origin of replication (such vectors are described in, e.g., Piechaczek C et al. Nucleic Acids Res. 1999; 27(2):426-428).

Vectors described herein usually do not integrate with the host genome. Non-genome-integrating vectors are an AOTI and this characteristic can be applied to any of the various vectors and constructs described herein.

i. Non-Viral Nucleic Acid Vectors

In AOTI, the compositions of the invention comprise, and methods of the invention comprise, the use of non-viral nucleic acid vectors. Non-viral nucleic acid vectors are vectors (or "nucleic acid vectors") in this disclosure means vectors that (a) do not comprise more than about 65%, in some cases more than about 75%, and in still other cases more than about 85% of the genome of any single virus, (b) do not result in the expression of complete viral particles capable of invading host cells, or (c) both (a) and (b). Nucleic acid vectors can be RNA constructs, such as RNA vaccines described above, or DNA vectors, such as DNA plasmids or linear expression elements.

DNA constructs useful in the present compositions can be "naked" DNA vectors (as described in, e.g., Restifo et al. Gene Therapy 2000; 7:89-92). Naked nucleic acid vectors are compositions of nucleic acids that are free of any association with viral capsid proteins in stable composition or when delivered in a method. In AOTI, nucleic acid vectors used in compositions or methods of the invention are not associated with any polypeptides, in particular not with polypeptides of viral origin, when in stable composition or administered to a subject (however, such constructs may encode one or more viral polypeptides as antigens). NAVs also can be associated with various TFAs, as DFEH.

A nucleic acid vector can be in the form of a circular plasmid or a linear nucleic acid (e.g., a DNA linear expression element or a mRNA). In a typical facet of the invention, a DNA construct is in the form of a circular DNA plasmid. The term "plasmid" refers to any suitable circular double stranded DNA loop into which additional DNA segments can be ligated. A conventional plasmid is a circular DNA vector that includes at least one expression cassette and a separate plasmid "backbone." As described above, an expression cassette is a nucleic acid construct capable of directing the expression of a RNA transcript coding for a polypeptide of interest. An expression cassette generally includes a promoter recognized by the host organism and that is operably linked to the coding sequence, i.e., the DNA sequence encoding for the RNA transcript that is translated to produce the polypeptide of interest. As described in detail above, an expression cassette may also contain, among other things, sequences necessary for the termination of transcription and for stabilizing the resulting mRNA, such as regions transcribed as polyadenylated fragments in the untranslated portion of the mRNA encoding for the polypeptide of interest. Typically, a plasmid backbone is the DNA sequence located between the two ends of an (or each) expression cassette. As noted, a backbone can comprise one or more functional sequences, such as an origin of replication and a selectable marker. Such selectable markers may include, for example, an antibiotic resistance gene, examples of which are discussed elsewhere in this disclosure. As many plasmids were originally used for replication in prokaryotes, such as bacteria, plasmids have historically included a number of bacterial sequences. Plasmid backbones also can be engineered to include restriction sites, such as polylinkers.

Numerous plasmid backbones are available in the art, including pVax and pcDNA3 plasmids (Thermo Fischer, Scientific, Waltham, Mass., USA). Nucleic acid vectors are reviewed in, e.g., Rodriguez E G. Nonviral DNA vectors for immunization and therapy: design and methods for their obtention. J Mol Med (Berl). 2004; 82(8):500-509 and Gómez and Oñate, "Plasmid DNA Vaccines" DOI: 10.5772/intechopen.76754. An example of an exemplary plasmid vector that can be incorporated in compositions of the invention and used in certain methods of the invention is provided in the Examples, below (plasmid constructs pMBF116-CMVp-Ub-CP204L-T2A-GFP-TcnR & plasmid pMBF117-CAGp-Ub-CP204L-T2A-GFP-TcnR).

Another exemplary type of nucleic acid vector that may be suitable in certain contexts are minicircle vectors (SFE US20040214329 and US20110244566). Minicircle vectors typically differ from bacterial plasmids in that they lack an origin of replication, and lack selectable markers commonly found in bacterial plasmids, e.g., P-lactamase, tet, and the like. Consequently, minicircles are small in size, allowing more efficient delivery to a cell. More importantly, minicircles are often devoid of the transgene expression silencing effect which is associated with these plasmid backbone nucleic acid sequences. DNA minicircles (MCs) devoid of the majority of the plasmid backbone are known in the art (SFE U.S. Patent Publication 2004/0214392).

A similar type of vector is known as a mini-intronic plasmid (MIP), in which the essential bacterial elements for plasmid replication and selection that are included in the plasmid backbone of conventional pDNA (i.e., the bacterial origin of replication and the selectable marker) are placed within an engineered intron within the expression cassette (SFE U.S. Patent Publication 2013/0210897). As with DNA minicircle vectors, using MIP vectors does not result in reduced expression over time of the polypeptide of interest, as seen with conventional pDNA vectors. Furthermore, using such vectors results in significantly increased expression of the polypeptide of interest, as compared to DNA minicircle vectors containing the same expression cassette.

Finally, MIP vectors are relatively simple to produce (see Lu, J., Zhang, F. and Kay, M. A. (2013), A mini-intronic plasmid (MIP): a novel robust transgene expression vector in vivo and in vitro, Mol Ther 21: 954-63, which is incorporated by reference herein in its entirety). Unlike a conventional plasmid, a MIP vector does not include a plasmid backbone region separate from the expression cassette. MIPs are further described in U.S. Pat. Nos. 9,347,073, 9,827,308, and Šimčíková M, Prather K L, Prazeres D M, Monteiro G A. Towards effective non-viral gene delivery vector. Biotechnol Genet Eng Rev. 2015; 31(1-2):82-107.

In some embodiments, the MIP intron is operably linked to the same promoter that mediates the expression of the polypeptide of interest by the MIP vector. Thus, the MIP intron is an integral part of the expression cassette. In such instances, the MIP intron may be located in any configuration relative to the sequence encoding for the polypeptide of interest (the "coding sequence"). In some embodiments, the MIP intron may be located upstream, or 5', of the coding sequence, i.e., between the promoter and the initiation codon for the coding sequence. In other embodiments, the MIP intron may be located within the coding sequence, i.e., flanked by two exons of the coding sequence. In other embodiments, the MIP intron may be located downstream of the coding sequence. For example, if the coding sequence does not include a termination sequence, the MIP intron may be placed downstream of the coding sequence and upstream of an exogenous termination, e.g., a polyadenylation, sequence. In some aspects, the intron of the MIP vector comprises an expression-enhancing intron, such as those described elsewhere herein.

An MIP vector typically is substantially free of any bacterial plasmid backbone sequences other than those sequences that are included within the MIP intron. Specifically, the MIP vector is devoid of any bacterial origin of replication or selectable marker located outside of the MIP intron. Furthermore, the MIP vector is generally restricted to an extra-genic spacer length of 500 nucleotides or less. Such a vector may have no more than about 50 nt, no more than 40 nt, no more than 25 nt, no more than 10 nt, no more than 5 nt bacterial sequence derived from the plasmid backbone. In some instances, a mini-intronic plasmid vector is a vector that is substantially free of any bacterial sequences other than those comprised by the intronic cassette, i.e., the plasmid has no more than about 50 nt, no more than 40 nt, no more than 25 nt, no more than 10 nt, no more than 5 nt bacterial sequence derived from the plasmid backbone. In some instances, as when the expression cassette comprises the intronic cassette. A typically MIP vector is generally at least about 0.3 kb long, often at least about 1.0 kb long, where the vector may be as long as 5 kb or longer, in some instances 10 kb or 20 kb or longer, but in certain embodiments do not exceed this length. Any convenient method may be employed, e.g., as known in the art or described below, to determine if a vector is able to enter a cell and if CSs are able to be expressed from the vector.

Mini-intronic plasmid vectors may be prepared in any of a number of ways using standard molecular biology techniques. For example, an origin of replication and selectable marker may be cloned into the endogenous intron of a transgene of interest, e.g., a transgene comprised by an expression cassette on a cloning vector, to create an intronic cassette, and the origin of replication and selectable marker of the cloning vector removed by restriction endonuclease digestion and self-ligation. The mini-intronic plasmid vector may then be propagated in cells, and cells comprising the vector selected for using the selection marker in the intronic cassette. Alternatively, an intronic cassette comprising a polynucleotide comprising an origin of replication and a selectable marker flanked by a splice donor sequence and a splice acceptor sequence may be isolated from a vector by excision by, e.g. restriction endonuclease digestion; the intronic cassette may be purified by, e.g. gel purification; the purified intronic cassette may be inserted into the expression cassette of a vector comprising the transgene; and the origin of replication and selectable marker of the cloning vector removed by restriction endonuclease digestion and self-ligation. An MIP vector may then be propagated in cells, and cells comprising the vector selected via a selection marker in the intronic cassette.

Compositions and methods of the invention also or alternatively can incorporate a linear nucleic acid vaccine, or linear expression cassette ("LEC") (sometimes alternatively called a "linear expression element"), which can serve as a vector in any suitable part of this disclosure directed to vectors. An LEC may be any linear DNA devoid of any phosphate backbone. An LEC may be derived from any plasmid capable of being linearized. In AOTI, LECs are incorporated or used as vectors that exhibit a low amount (less than 10%, less than 5%, or less than 2%) or no amount of sequences derived from bacteria (this principle can also apply to minicircle and other vectors of the invention). Examples of linear vector constructs are described in, e.g., Wong S, Lam P, Nafissi N, Denniss S, Slavcev R. Production of Double-stranded DNA Ministrings. J Vis Exp. 2016; (108):53177. Published 2016 Feb. 29. doi:10.3791/53177; Walters A A, Kinnear E, Shattock R J, et al. Comparative analysis of enzymatically produced novel linear DNA constructs with plasmids for use as DNA vaccines. Gene Ther. 2014; 21(7):645-652; Nafissi N, Alqawlaq S, Lee E A, Foldvari M, Spagnuolo P A, Slavcev R A. DNA ministrings: highly safe and effective gene delivery vectors. Mol Ther Nucleic Acids. 2014; 3(6):e165. Published 2014 May 27; WO2019161059; and WO2019246544. Linear DNA constructs may be advantageous in certain situations as discussed in Cherng, J Y et al., J. Control. Release 60:343-53 (1999), & Chen, Z Y et al. Mol. Ther. 3:403-10 (2001).

Examples of known NAVs suitable for AOTI include minicircle, minivector, miniknot, MIDGE, MiLV, Ministring, and Mini-intronic plasmid vectors. NAVs can be in the form of plasmids, or other naked DNA constructs. Examples of such vectors are described in Hardee C L, et al. Genes (Basel). 2017; 8(2):65 and Williams J A. Vaccines (Basel). 2013; 1(3):225-249.

In view of the foregoing it will be clear that generally a variety of nucleic acid vectors can be incorporated in compositions of the invention or used in methods of the invention, including a linear expression element (as described in, e.g., Sykes and Johnston (1997) Nat Biotech 17:355-59), a compacted nucleic acid vector (as described in, e.g., U.S. Pat. No. 6,077,835 and/or International Patent Application WO 00/70087), a plasmid vector such as pBR322, pUC 19/18, or pUC 118/119, a "midge" minimal-sized nucleic acid vector (as described in, e.g., Schakowski et al. (2001) Mol Ther 3:793-800, and the nucleic acid vectors described in U.S. Pat. Nos. 5,589,466 and 5,973,972. In AOTI, the nucleic acid vector is a plasmid vector, formed of a closed circular DNA molecule. As suggested already above, a plasmid may include one or more sequences from a viral nucleic acid. However, such viral sequences normally are not sufficient to direct or allow the incorporation of the plasmid into a viral particle, and the plasmid is therefore a non-viral vector. Certain compositions of the invention can comprise a plurality of vectors, such as a plurality of nucleic acid vectors, such as a plurality of plasmid vectors.

ii. Viral Vectors

A vector that is either composed of or encodes a viable virus capable of infecting host cells is referred to herein as a "viral vector." There are a large number of available viral vectors suitable for use with the compositions of the instant disclosure, including those identified for human gene therapy applications (see Pfeifer and Verma, Ann. Rev. Genomics Hum. Genet. 2:177, 2001). For example, a viral vector may be selected from the following: a retrovirus, an adenovirus, an adeno-associated virus, a herpes virus, a pox virus, a human foamy virus (HFV), a lentivirus, or any other virus delivery vector known in the art. In AOTI, vectors used in compositions and methods of this disclosure can be DNA viral vectors, including, for example adenovirus-based vectors and adeno-associated virus (AAV)-based vectors; vectors derived from herpes simplex viruses (HSVs), including amplicon vectors, replication-defective HSV and attenuated HSV (Krisky et al., Gene Ther. 5: 1517, 1998). In an exemplary embodiment, a viral vector is selected from the group consisting of adenovirus vectors, adeno-associated virus (AAV) vectors (e.g., AAV type 5 and type 2), alphavirus vectors (e.g., Venezuelan equine encephalitis virus (VEE), sindbis virus (SIN), semliki forest virus (SFV), and VEE-SIN chimeras), herpes virus vectors (e.g. vectors derived from cytomegaloviruses, like rhesus cytomegalovirus (RhCMV), arena virus vectors (e.g. lymphocytic choriomeningitis virus (LCMV) vectors), measles virus vectors, and poxvirus vectors. Examples of adenoviral vectors, alphavirus replicons, herpes virus vectors, pox virus vectors, and rhabdovirus vectors, are described in, e.g., Jolly (1994) Cancer Gene Therapy 1:51; Latchman (1994) Molec. Biotechnol. 2:179; Johanning et al. (1995) Nucl. Acids Res. 23:1495; Berencsi et al. (2001) J. Infect. Dis. 183:1171; Rosenwirth et al. (2001) Vaccine February 19:1661; Kittlesen et al. (2000) J. Immunol. 164:4204; Brown et al. (2000) Gene Ther. 7:1680; Kanesa-thasan et al. (2000) Vaccine 19:483; and Sten (2000) Drug 60:249.

Viral vectors also include vectors based on RNA viruses, such as retrovirus-derived vectors, e.g., Moloney murine leukemia virus (MLV)-derived vectors, and include more complex retrovirus-derived vectors, e.g., lentivirus-derived vectors (e.g., HIV, FIV, equine infectious anemia virus, bovie immunodeficiency virus (BIV), simian immunodeficiency virus (SIV), and Maedi-Visna virus (ovine lentivirus) vectors) (SFE U.S. Pat. No. 8,119,772; Walchli et al., PLoS One 6:327930, 2011; Zhao et al., J. Immunol. 174:4415, 2005; Engels et al., Hum. Gene Ther. 14:1155, 2003; Frecha et al., Mol. Ther. 18:1748, 2010; Verhoeyen et al., Methods Mol. Biol. 506:97, 2009).

A number of adenovirus vectors have also been described. Unlike retroviruses which integrate into the host genome, adenoviruses persist extrachromosomally thus minimizing the risks associated with insertional mutagenesis (Haj-Ahmad and Graham, J. Virol. (1986) 57:267-274; Bett et al., J. Virol. (1993) 67:5911-5921; Mittereder et al., Human Gene Therapy (1994) 5:717-729; Seth et al., J. Virol. (1994) 68:933-940; Barr et al., Gene Therapy (1994) 1:51-58; Berkner, K. L. BioTechniques (1988) 6:616-629; and Rich et al., Human Gene Therapy (1993) 4:461-476). Molecular conjugate vectors, such as the adenovirus chimeric vectors described in Michael et al., J. Biol. Chem. (1993) 268:6866-6869 and Wagner et al., Proc. Natl. Acad. Sci. USA (1992) 89:6099-6103, can also be used for delivery of constructs of the invention. Adenoviral vectors can be derived from any suitable species and serotype of adenoviral vector, such as the primate adenoviral vectors (e.g., Ad68) described in the Wistar Art, and the widely used/studied human Ad2 and Ad5 vectors, as described for example in Curiel, D T and Douglas J T (2002) Adenoviral Vectors for Gene Therapy (Elsevier Inc.). An adenoviral vector can, e.g., be or can be derived from a human adenovirus vector, a simian adenovirus vector, a group B adenovirus vector, a group C adenovirus vector, a group E adenovirus vector, an adenovirus 6 vector, a PanAd3 vector, an adenovirus C3 vector, a ChAdY25 vector, an AdC68 vector and an Ad5 vector. Methods of modifying, packaging, and purifying any of these adenoviral vectors and other recombinant viral vectors are well known in the art, SFE Viral Vectors for Gene Therapy: Methods and Protocols. (NewJersey: Humana Press Inc.), the full disclosures of which are incorporated herein by reference.

Additionally, various adeno-associated virus (AAV) vector systems have been developed for gene delivery. AAV vectors can be readily constructed using techniques well known in the art. SFE U.S. Pat. Nos. 7,078,387; 5,173,414; and 5,139,941; International Publication Nos. WO 92/01070 (published 23 Jan. 1992) and WO 93/03769 (published 4 Mar. 1993); Lebkowski et al., Molec. Cell. Biol. (1988) 8:3988-3996; Vincent et al., Vaccines 90 (1990) (Cold Spring Harbor Laboratory Press); Carter, B. J. Current Opinion in Biotechnology (1992) 3:533-539; Muzyczka, N. Current Topics in Microbiol. and Immunol. (1992) 158:97-129; Kotin, R. M. Human Gene Therapy (1994) 5:793-801; Shelling and Smith, Gene Therapy (1994) 1:165-169; and Zhou et al., J. Exp. Med. (1994) 179:1867-1875. Recombinant adeno-associated viruses ("AAVs"), can be of or derived from any suitable type of AAV including, e.g. AAV1, AAV2, AAV3, AAV4, AAV5, AAV6, AAV7, AAV8, AAV9, AAV10, AAV11, and AAV12, as described for example in Flotte, T R and Berns, K I., Hum Gene Ther. 2005; 16(4):401-407.

A number of retroviral systems also have been described that might be used in certain aspects of the invention. Examples of such vector systems are described in, e.g., U.S. Pat. No. 5,219,740; Miller et al. (1989) BioTechniques 7:980; Miller, A. D. (1990) Human Gene Therapy 1:5; Scarpa et al. (1991) Virology 180:849; Burns et al. (1993) Proc. Natl. Acad. Sci. USA 90:8033; Boris-Lawrie et al. (1993) Cur. Opin. Genet. Develop. 3:102; GB 2200651; EP 0415731; EP 0345242; WO 89/02468; WO 89/05349; WO 89/09271; WO 90/02806; WO 90/07936; WO 90/07936; WO 94/03622; WO 93/25698; WO 93/25234; WO 93/11230; WO 93/10218; WO 91/02805; in U.S. Pat. Nos. 5,219,740; 4,405,712; 4,861,719; 4,980,289 and 4,777,127; in U.S. Ser. No. 07/800,921; and in Vile' (1993) Cancer Res 53:3860-3864; Vile (1993) Cancer Res 53:962-967; Ram (1993) Cancer Res 53:83-88; Takamiya (1992) J Neurosci Res 33:493-503; Baba (1993) J Neurosurg 79:729-735; Mann (1983) Cell 33:153; Cane (1984) Proc Natl Acad Sci USA 81; 6349; and Miller (1990) Human Gene Therapy 1. In some embodiments, recombinant nucleic acids can be transferred into target cells, such as T cells, using recombinant lentiviral vectors or retroviral vectors, such as gammaretroviral vectors (SFE Koste et al. (2014) Gene Therapy 2014 Apr. 3; Carlens et al. (2000) Exp Hematol 28(10): 1137-46; Alonso-Camino et al. (2013) Mol Ther Nucl Acids 2, e93; Park et al., Trends Biotechnol. 2011 November; 29(11): 550-557. A number of illustrative retroviral systems have been described (e.g., U.S. Pat. Nos. 5,219,740; 6,207, 453; 5,219,740; Miller and Rosman (1989) BioTechniques 7:980-990; Miller, A. D. (1990) Human Gene Therapy 1:5-14; Scarpa et al. (1991) Virology 180:849-852; Burns et al. (1993) Proc. Natl. Acad. Sci. USA 90:8033-8037; and Boris-Lawrie and Temin (1993) Cur. Opin. Genet. Develop. 3:102-109. Methods of lentiviral transduction are known. SFE Wang et al. (2012) J. Immunother. 35(9): 689-701; Cooper et al. (2003) Blood. 101:1637-1644; Verhoeyen et al. (2009) Methods Mol Biol. 506: 97-114; & Cavalieri et al. (2003) Blood. 102(2): 497-505.

Additional viral vectors which will find use for delivering the nucleic acid molecules encoding the antigens of interest include those derived from the pox family of viruses, including vaccinia virus and avian poxvirus. An example of such a vector system useful for delivering polynucleotides is the recombinant poxvirus vaccines described by Small, Jr., P. A., et al. (U.S. Pat. No. 5,676,950, issued Oct. 14, 1997, herein incorporated by reference). Vaccinia virus-based infection/transfection systems can be conveniently used to provide for inducible, transient expression of the coding sequences of interest in a host cell. SFE Elroy-Stein and Moss, Proc. Natl. Acad. Sci. USA (1990) 87:6743-6747; Fuerst et al., Proc. Natl. Acad. Sci. USA (1986) 83:8122-8126.

Alternatively, avipoxviruses, e.g., the fowlpox & canarypox viruses, can also be used to deliver constructs. Recombinant avipox viruses, expressing immunogens from mammalian pathogens, are known to confer protective immunity when administered to non-avian species. The use of an avipox vector is particularly desirable in human and other mammalian species since members of the avipox genus can only productively replicate in susceptible avian species and therefore are not infective in mammalian cells. Methods for producing recombinant avipoxviruses are known in the art and employ genetic recombination, as described above with respect to the production of vaccinia viruses. SFE WO 91/12882; WO 89/03429; and WO 92/03545.

Members of the Alphavirus genus, such as, but not limited to, vectors derived from the Sindbis, Semliki Forest, and Venezuelan Equine Encephalitis viruses, will also find use as viral vectors for delivering the polynucleotides of the present invention (for example, a synthetic Gag-polypeptide encoding expression cassette). For a description of Sindbis-virus derived vectors ATAOTI, see, Dubensky et al., J. Virol. (1996) 70:508-519; and International Publication Nos. WO 95/07995 and WO 96/17072; as well as U.S. Pat. Nos. 5,843,723 and 5,789,245.

Another type of viral vector that can be employed with polynucleotides and methods of the invention is a papillomaviral vector. Suitable papillomaviral vectors are known in the art and described in, e.g., Hewson (1999) Mol Med Today 5(1):8, Stephens (1987) Biochem J 248(1):1-11, and U.S. Pat. No. 5,719,054. Particularly preferred papillomaviral vectors are provided in, e.g., International Patent Application WO 99/21979. [00367] Alphavirus vectors can be gene delivery vectors in other contexts. Alphavirus vectors are known in the art and described in, e.g., Carter (1992) Curr Opinion Biotech 3:533-539, Muzcyzka (1992) Curr Top Microbiol Immunol. 158:97-129, Schlesinger Expert Opin Biol Ther. 2001 March; 1(2): 177-91, Polo et al. Dev Biol (Basel). 2000; 104:181-5, Wahlfors et al. Gene Ther. 2000 March; 7(6):472-80, Colombage et al. Virology. 1998 Oct. 10; 250(1):151-63, and International Patent Applications WO 01/81609, WO 00/39318, WO 01/81553, WO 95/07994, and WO 92/10578.

Another group of viral vectors are the herpes viral vectors. Examples of herpes viral vectors are described in, e.g., Lachmann et al., Curr Opin Mol Ther 1999 October; I(5): 622-32, Fraefel et al., Adv Virus Res. 2000; 55:425-51, Huard et al., Neuromuscul Disord. 1997 July; 7(5):299-313, Glorioso et al., Annu Rev Microbiol. 1995; 49:675-710, Latchman, Mol Biotechnol. 1994 October; 2(2): 179-95, and Frenkel et al., Gene Ther. 1994; 1 Suppl S40-6, as well as U.S. Pat. Nos. 6,261,552 and 5,599,691.

Still another example of a viral vector is a flaviviral vector. Examples of suitable vectors are described in, e.g., Bonaldo et al., Mem Inst Oswaldo Cruz. 2000; 95 Suppl 1:215-23, Caufour et al. Virus Res. 2001 Nov. 5; 79(1-2): 1-14, Guirakhoo et al. J Virol. 2001 August; 75(16):7290-304, Pletnev et al. Virology. 2000 Aug. 15; 274(1):26-31, Guirakhoo et al. J Virol. 2000 June; 74(12):5477-85, and WO 93/06214 and WO 01/53467.

iii. Bacterial/Cellular "Vectors"/Delivery Systems

In another aspect of the invention, one or more nucleic acid molecules of the invention can also be incorporated into and delivered by a cellular delivery system, such as an attenuated "bacterial vector," such as an attenuated *Salmonella typhimurium*, e.g., the doubly attenuated (AroA-, dam-) strain of *Salmonella typhimurium*. Examples of suitable attenuated live bacterial vectors that can be transformed to incorporate a construct include *Salmonella typhimurium*, *Salmonella typhi*, *Shigella* species, *Bacillus* species, *Lactobacillus* species, Bacille Calmette-Guerin (BCG), *Escherichia coli*, *Vibrio cholerae*, *Campylobacter* species, *Listeria* species, or any other suitable bacterial vector, as is known in the art. Other cellular vectors/delivery systems are known in the art, such as nucleic acid construct loaded dendritic cell delivery systems mentioned elsewhere in this disclosure.

iv. Vector Functional Characteristics

In some aspects, vectors incorporated in compositions of the invention or used in methods of the invention can also or alternatively be characterized on the basis of one or more functional properties. For example, In AOTI, one, some, most, or all vectors of the composition or method will be characterizable as being non-replicative, at least in stable composition, hosts receiving the vector as part of a treatment method, or both. Vectors also or alternatively can be characterized as non-infectious, not spreading from one organism to another. Vectors also or alternatively can be characterized as nonintegrating. While expression of integrated sequences from vectors that integrate into host genomes is possible and desirable in some aspects of biotechnology, in most aspects of the invention the vectors used in the compositions and methods described herein typically will persist in an episomal/extragenomic state. Vectors of the invention also will typically be non-pathogenic, such that, for example, viral vectors will have had most, substantially all, or all of known/consistent sequences associated with virus pathogen effects removed by deletion or modification.

In the case of viral vectors, modifications known in the art are required in order to render the viral vector sufficiently replication-incompetent (sometimes called replication-deficient) or non-infectious where such characteristics are desired. Typically, viral vectors will retain their ability to infect host cells. AAV vectors, which are naturally replication-deficient in the absence of complementing adenoviruses or at least adenovirus gene products (provided by, e.g., a helper virus, plasmid, or complementation cell), are one example of a replication-deficient vector. By "replication-deficient" is meant that the viral vector comprises a genome that lacks at least one replication-essential gene function. A deficiency in a gene, gene function, or gene or genomic region, as used herein, is defined as a deletion of sufficient genetic material of the viral genome to impair or obliterate the function of the gene whose nucleic acid sequence was deleted in whole or in part. Replication-essential gene functions are those gene functions that are required for replication (i.e., propagation) of a replication-deficient viral vector. The essential gene functions of the viral vector particle vary with the type of viral vector particle at issue. Examples of replication-deficient viral vector particles are described in, e.g., Marconi et al., Proc. Natl Acad. Sci. USA, 93(21), 11319-20 (1996), Johnson and Friedmann, Methods Cell Biol, 43 (pt. A), 211-30 (1994), Timiryasova et al., J. Gene Med, 3(5), 468-77 (2001), Burton et al., Stem Cells, 19(5), 358-77 (2001), Kim et al., Virology, 282(1), 154-67 (2001), Jones et al., Virology, 278(1), 137-50 (2000), Gill et al., J. Med. Virol, 62(2), 127-39 (2000), Chen and Engleman, J. Virol, 74(17), 8188-93 (2000), Marconi et al., Gene Ther., 6(5), 904-12 (1999), Krisky et al., Gene Ther., 5(11), 1517-30 (1998), Bieniasz et al., Virology, 235(1), 65-72 (1997), Strayer et al., Biotechniques, 22(3), 447-50 (1997), Wyatt et al., Vaccine, 14(15), 1451-8 (1996), and Penciolelli et al., J. Virol, 61(2), 579-83 (1987). Other replication-deficient vectors are based on simple MuLV vectors. SFE Miller et al. (1990) Mol Cell Biol 10:4239 (1990); Kolberg (1992) J NTS Res 4:43, and Cornetta et al. (1991) Hum Gene Ther 2:215). For a review of replication-incompetent chimpanzee-derived adenovirus, see U.S. Pat. No. 6,019,978. Human replication-deficient adenoviral vectors and systems and method for the production thereof are described in, e.g., US 20030087438, US 20030054553, US 20030040100, US 20020031831, and US 20030175245.

v. Vector Size

Vectors of the invention can also or alternatively be characterized on the basis of size of the nucleotide sequences that make up the vector (or at least the nucleic acid portion of the vector).

In AOTI, the invention provides plasmid vectors that comprise sequences that are larger than sequences that can be usually incorporated into many viral vectors, such as adenoviral vectors. Thus, for example, In AOTI, the invention comprises compositions comprising and methods involving the use of one or more vectors that comprise nucleotide sequence of at least about 2.25 kb, such as at least about 2.5 kb, at least about 3 kb, or at least about 4 kb of sequences comprising one or more expression cassettes comprising sequences encoding one or more antigens and dendritic cell-binding domains or polypeptides (e.g., about 2-5 kb, about 2.1-4.9 kb, about 2.2-4.8 kb, about 2.25-4.75 kb, about 2-4 kb, about 2-3 kb, about 2.1-3.1 kb, about 2.3-3.3 kb, about 2.3-3.8 kb, or about 2.3-about 2.5 kb).

In an alternative aspect, the invention provides vectors that also or alternatively are minimized in terms of sequences outside of the expression cassette(s) of the vector (s), such as the MIP vectors described above. In one such aspect, one, some, most, generally all, or all of the vectors of a method or composition of the invention are characterized in comprising less than about 1.5 kb, less than about 1.25 kb, less than about 1 kb, less than about 0.85 kb, less than about 0.75 kb, less than about 0.5 kb, less than about 0.33 kb, or less than about 0.25 kb outside of the expression cassette or expression cassettes contained in the vector.

vi. Multi-Gene and Multi-Cistronic Vectors

In AOTI, the invention provides vectors that express multiple products. In some aspects, the compositions and methods of the invention can comprise one or more vectors (or primarily comprise, generally consist of, or consist of one or more vectors) that comprise a plurality of nucleic acid sequences to be expressed in a host cell as separate transcripts (e.g., two or more expression cassettes), generate two or more cistrons (e.g., one more expression cassettes comprising coding sequences that are processed to form two or more discrete polypeptides when the coding sequences are expressed). It is worth noting that "expression" in its broadest sense can be understood as the process of converting genetic information encoded by nucleic acids into final end products. As such, expression in such contexts encompasses the processing of an initial, immature mRNA or PPT into a more stable form.

Vectors of the invention can include any suitable number of expression cassettes. Vectors comprising multiple expression cassettes can be referred to as "multi-gene" vectors. Typically, a vector of the invention will comprise 1-3 expression cassettes, 1-2 expression cassettes, or only a single expression cassette. Vectors comprising two or more expression cassettes or two or more coding sequences that when processed form two discrete transcripts can be described as "multi-gene vectors."

Vectors of the invention can also or alternatively encode sequences that cause a single gene to be expressed as two or more expression products (cistrons). Such multicistronic vectors simultaneously express 2+ separate proteins from the same mRNA. E.g., a vector comprising two expression cassettes may be described as a "bicistronic" vector. A vector comprising 3 expression cassettes may similarly be described as a "tricistronic" vector.

In AOTI, the vector of a method or composition of the invention is a multi-cistronic (or multicistronic) vector, such as a bicistronic vector, wherein the vector comprises one or more nucleotide sequences that facilitate processing of an expression product to form two or more discrete expression products. Examples of such sequences that can be incorporated into such vectors include internal ribosome entry sites (IRES), furin cleavage sites, viral 2A peptide sequences, or any combination thereof. Vectors encoding the nucleotide sequences of IRES or 2A peptides are called "multicistronic" vectors, since they simultaneously express two or more separate proteins from the same mRNA, even where the mRNA is encoded by a single expression cassette. Example of such vectors are described in, e.g., Shaimardanova et al., Pharmaceutics 2019, 11(11), 580. Examples of 2A peptides, which can facilitate "ribosome skipping," resulting in multiple expression products, are described elsewhere herein. An IRES can enable efficient translation of an mRNA lacking a 5' cap structure and can act as another ribosome recruitment site, thereby resulting in co-expression of two proteins from a single mRNA. Exemplary expression vectors that employ di-cistronic mRNAs are pTR-DC/GFP described by Mosser et al., Biotechniques 22:150-161, 1997, and p2A5I described in Morris et al., Animal Cell Technology, 1997, pp. 529-534.

In aspects, a vector also or alternatively can comprise multiple expression cassettes, multiple promoters, or promoters with certain capabilities (such as bi-directional promoters) that drive expression of different transcription units. An example of a multi-gene vector derived from coronavirus capable of expressing three different expression products in target cells, including dendritic cells, is described in Volker Thiel et al., Journal of Virology August 2003, 77 (18) 9790-9798; DOI: 10.1128/JVI.77.18.9790-9798.2003. Similar multi-gene vectors have been developed using lentiviral vectors. SFE Zhu Y et al. Mol Ther. 2001; 4(4):375-

382. doi:10.1006/mthe.2001.0469. Plasmids with multigene expression also are KITA. SFE Kriz A et al. Nat Commun. 2010; 1:120. doi:10.1038/ncomms1120.

In aspects, the vector or construct also or alternatively obtains multiple expression products through incorporation of a bidirectional promoter. Bidirectional promoter strategies are similarly known in the art. SFE Javan B et al. Life Sci. 2018; 202:140-151; Lejard V et al. Plasmid. 2014; 74:1-8; Polson A et al. Plasmid. 2011; 66(3):169-179.

Also or alternatively still, splicing signals can be incorporated into a construct to generate several mature mRNAs from a single pre-mRNA expressed from an expression cassette. An example of such a splicing strategy for obtaining a multi-cistronic vector is described in, e.g., Zhu Y et al. Mol Ther. 2001; 4(4):375-382. doi:10.1006/mthe.2001.0469. Multicistronic vectors and methods, including splicing methods, are generally reviewed in de Felipe P. Polycistronic viral vectors. Curr Gene Ther. 2002; 2(3):355-378 and are further exemplified in, e.g., Hildinger M et al. Gene Ther. 1999; 6(7):1222-1230.

The skilled reader of this disclosure can choose any combination of such approaches to making a multi-cistronic/multi-gene vector depending on the priority in the form of expression desired and the desired design of the relevant vector. For example, IRES sequences are typically large (over 500 bp) and can sometimes results in lower expression of the second gene product, located downstream of the IRES, than the first expression product, whereas in the case of 2A peptides there can be incomplete digestion of protein products, use of splicing signals can result in unintentional products and uncertain levels of expression products, and the use of multiple promoters or multiple expression cassettes can require large nucleotide sequences insertions into vectors and frequently can result in poor expression of one or both products encoded by the sequences of the vector. Thus, each known approach has tradeoffs, but all such methods can be used to suitably produce multiple expression products from a single vector where desired and where the possible negative effects of the system selected are outweighed by the benefits of a single multi-gene or multicistronic vector system.

Multi-cistronic constructs & compositions, and related PMCs that can be adapted to AOTI are further described in Mokrejs M, Vopálenský V, Kolenaty O, et al. et al. IRESite: the database of experimentally verified IRES structures (www.iresite.org). Nucleic Acids Res. 2006; 34(Database issue):D125-D130 and Santana V C et al. PLoS One. 2013; 8(8):e71322. Published 2013 Aug. 8.

vii. Targeted Vectors

In aspects, vector(s) in CEPESCs are targeted vectors. Targeted vector(s) comprise feature(s), that direct the vector to particular target(s), e.g., cell receptor(s), in TRs. In aspects, targeted vector(s) target ICR(s), such as ITIC receptor(s) (e.g., a DC receptor). In aspects, targeted vector(s) are viral vectors. Viral vectors, such as Vaccinia Virus (VV), Modified virus Ankara (MVA), certain lentiviral vectors, retroviral vectors, and Ad vectors exhibit targeting of DCs and other ICs. SFE Larocca C et al. Cancer J. 2011; 17(5):359-371; Sharma, P. K et al. Cancer Gene Ther 25, 27-38 (2018); Bryson P D et al. J Vis Exp. 2013; (76):50606; and US20150031625. E.g., Ad35 binds CD46, which is present on all types of DCs, and thus effectively targets such vectors to DCs. Viral vectors also can be modified to include heterologous PPTs that specifically bind targets, such as Ab AARSs against ICRs (SFE US20050003548 exemplifying the incorporation of Ab AARSs into fiber protein PPTs of recombinant Ad vectors & US20060286121 describing similar methods of targeting).

In aspects, targeted vectors are non-viral vectors, such as NAVs. Targeting compound-conjugated NAVs such as NAVs conjugated to PPTs/moieties targeting ICs, e.g., DCs, also are known in the art (SFE Anderson K et al. Bioconjug Chem. 2010; 21(8):1479-1485).

Vectors also can be targeted to internal targets. E.g., plasmid vectors can be conjugated to nuclear localization signals (NLSs) (e.g., Arg/Lys rich AARSs recognized by karyopherins such as importin a resulting in facilitated transport across the nuclear envelope) (SFE Hardee C L, et al. Genes (Basel). 2017; 8(2):65. Published 2017 Feb. 10.

Targeted vectors are known in the art as are methods for developing such vectors that can be adapted to AOTI. E.g., methods relevant to the generation of targeted vectors that can be adapted to AOTI are provided in US20080019988, WO1999041402, WO1999041368, and WO1999041369.

viii. Multi-Vector/Muti-EPESNAM Compositions

In AOTI, the compositions and methods of the invention comprise 2+ vectors, (e.g., 2, 2-3, or 2-5 vectors); 2+ EPESNAM(s); or both. In aspects, each EPESNAM is contained in a separate vector or is a NAV. Thus, for example, compositions of the invention can comprise, e.g., 1-5 vectors, 1-4 vectors, or 1-3 vectors. The use of multiple vectors can offer several advantages, including ability to control dosage, ability to efficiently produce the different vectors, and the ability to "mix and match" various vector constructs for different applications. Thus, for example, in one aspect a method of the invention can comprise selecting one, two, three, or more vectors from a bank of vectors comprising antigen-encoding sequences that induce an immune response against a particular disease-causing agent. In AOTI, one or more of the multiple vectors in a multiple vector composition or method is a multicistronic vector. In AOTI, none of the vectors in a multi-vector composition or method are multicistronic vectors. Numerous specific examples of multiple vector compositions and methods are exemplified herein and provided by the invention. One such exemplary composition and method comprises one vector that comprises a gD:antigen fusion protein-encoding sequence and a second vector that comprises a non-antigen immunomodulator, such as an innate trained immunity immunomodulator (ITII), such as an EAT-2 polypeptide, or a cytokine, such as an interleukin. In another exemplary aspect, which can be reflected in a composition of the invention or method of the invention, at least a first vector, such as a plasmid vector, comprising a gD:antigen fusion protein-encoding sequence is combined with or used with a second plasmid vector comprising a different antigen-encoding sequence, which optionally may be associated with a targeting sequence/domain, a different innate cell activator sequence or polypeptide, or both.

D. Compositions Comprising NAMs

CEPESC(s) are an AOTI. CEPESC(s) comprise 1+, 2+, 3+, or more NAMs (e.g., NAVs) that collectively comprise the CESs of the composition (all of the CS(s) encoding all of the EPs of the composition). In aspects, OSMGAOA of the NAMs, NAM molecules, or both are associated with one or more delivery agent(s) (DA(s)). In aspects, CEPESC(s) comprise one or more excipient(s). In aspects, CEPESCs comprise both. CEPESCs are suitable for pharmaceutical

1. Delivery Agents (TFA(s)) & Delivery Systems

In aspects, CEPESCs comprise delivery agent(s) associated with NAM(s). Combinations of NAM(s) and delivery agent(s) can be referred to as "delivery systems." A delivery agent ("DA") is any composition that DOS enhances the uptake of the NAM(s) resulting in expression of the ES(s) they contain. DAs also are referred to herein as transfection-facilitating agents or TFAs. Some aspects of DAs and other components of CEPESCs, such as PPT components of viral vectors, can overlap. Skilled readers will understand that such categorization(s) of CEPESC components are presented in a non-limiting manner as a matter of convenience in describing AOTI.

NAM(s) can be bound to, coated on, or contained in particle DAs (PDAs). In aspects, NDA(s) are coated with additional DA(s), e.g., cationic composition(s), targeting compositions (e.g., ligands for ICR(s)), or both. In aspects, NAMs are in viral vectors comprising viral nanoparticles or viral-derived nanoparticles. CEPESCs also can comprise virus-like particle PDA(s). As with NAMs, terms such as "particles" and "nanoparticles" typically refer to types of particles/nanoparticles and not specific particle molecules, which can, e.g., number in the millions in CEPESCs.

In aspects, TFA(s) are targeted to tissue(s), organ(s), or cell type(s). As also DEH, targeting method include incorporation of Ab AARS(s), ligand AARS(s), or other compounds, e.g., aptamers to ICR(s) or CpG(s) that are bound by DEC-205, etc., which are either bound directly to NAM(s) or are bound or otherwise associated with PDA(s) (e.g., a liposome PDA, a polymeric DA, or protein component(s) of a viral vector). Such and other PDA(s) can comprise, e.g., DNA binding proteins or polypeptides, liposomes, extracellular vesicles, exosomes, or other positively charged macromolecules used alone or in combination) that binds NAM(s) of the CEPESC. Extracellular vesicles are membranous vesicles released by a variety of cells into the extracellular microenvironment and include ectosomes or microvesicles (ii), exosomes and (iii), apoptotic bodies. Such materials are described in Raposa et al. J Cell Biol. 2013 Feb. 18; 200(4):373-83. Targeting methods adaptable to PDA(s)/DA(s) are described in David et al. (2012), J Gene Med 14, 769-775; Deas, O et al. (2002), Human Gene Therapy 13, 1101-1114; Hyodo, M., et al. Journal of Controlled Release 14, 241-247; and Ye, C et al., Eur. J. Immunol. Transfection facilitating agent(s) also can include surface active agents, such as immune-stimulating complexes (ISCOMS), LPS analog(s) including monophosphoryl lipid A, muramyl peptides, quinone analogs, vesicles such as squalene and squalene, hyaluronic acid, lipids, liposomes, calcium ions, viral proteins, polyanions, polycations, or nanoparticles, or other known TFA(s). Polyanion and polycation TFAs are known, including poly-L-glutamate (LGS). In aspects, TFA(s) comprise poly-L-glutamate, lecithin liposomes or other liposomes known in the art (SFE WO9324640), or calcium ions. In AOTI, NAM(s) are CB DA/PDA full encapsulation, partial encapsulation, non-encapsulation (conjugation), or CT.

In AOTI, a conjugated lipid inhibits aggregation of lipid particles, including, polyethylene glycol (PEG)-lipid conjugates such as, e.g., PEG coupled to dialkyloxypropyls (e.g., PEG-DAA conjugates), PEG coupled to diacylglycerols (e.g., PEG-DAG conjugates), PEG coupled to cholesterol, PEG coupled to phosphatidylethanolamines, and PEG conjugated to ceramides, cationic PEG lipids, polyoxazoline (POZ)-lipid conjugates (e.g., POZ-DAA conjugates; polyamide oligomers (e.g., ATTA-lipid conjugates), and mixtures thereof. In some embodiments, PEG or POZ can be conjugated directly to the lipid or may be linked to the lipid via a linker moiety. Any linker moiety suitable for coupling the PEG or the POZ to a lipid can be used including, e.g., non-ester containing linker moieties and ester-containing linker moieties. In some embodiments, non-ester containing linker moieties, such as amides or carbamates, are used.

In some embodiments, an amphipathic lipid can have a hydrophobic portion that orients into a hydrophobic phase, and a hydrophilic portion orients toward the aqueous phase. In some embodiments, hydrophilic characteristics derive from the presence of polar or charged groups such as carbohydrates, phosphate, carboxylic, sulfato, amino, sulfhydryl, nitro, hydroxyl, and other like groups. In some embodiments, hydrophobicity can be conferred by the inclusion of apolar groups that include, but are not limited to, long-chain saturated and unsaturated aliphatic hydrocarbon groups and such groups substituted by one or more aromatic, cycloaliphatic, or heterocyclic group(s). Examples of amphipathic compounds include, but are not limited to, phospholipids, aminolipids, and sphingolipids.

Representative examples of phospholipids include, but are not limited to, phosphatidylcholine, phosphatidylethanolamine, phosphatidylserine, phosphatidylinositol, phosphatidic acid, palmitoyloleoyl phosphatidylcholine, lyso-phosphatidylcholine, lysophosphatidylethanolamine, dipalmitoylphosphatidylcholine, dioleoylphosphatidylcholine, distearoylphosphatidylcholine, and dilinoleoylphosphatidylcholine. Other compounds lacking in phosphorus, such as sphingolipid, glycosphingolipid families, diacylglycerols, and (3-acyloxyacids, are also within the group designated as amphipathic lipids. Additionally, the amphipathic lipids described above can be mixed with other lipids including triglycerides and sterols.

In some embodiments, a neutral lipid exists either in an uncharged or neutral zwitterionic form at a selected pH. In some embodiments, at physiological pH, such lipids include, for example, diacylphosphatidylcholine, diacylphosphatidylethanolamine, ceramide, sphingomyelin, cephalin, cholesterol, cerebrosides, and diacylglycerols.

In AOTI, a non-cationic lipid may be any amphipathic lipid or neutral lipid(s)/anionic lipid(s). In AOTI, an anionic lipid is negatively charged at physiological pH. Lipids include, e.g., phosphatidylglycerols, cardiolipins, diacylphosphatidylserines, diacylphosphatidic acids, N-dodecanoyl phosphatidylethanolamines, N-succinyl phosphatidylethanolamines, N-glutarylphosphatidylethanolamines, lysylphosphatidylglycerols, palmitoyloleyolphosphatidylglycerol (POPG), & other anionic groups joined to neutral lipids.

In some embodiments, a hydrophobic lipid has apolar groups that include, but are not limited to, long-chain saturated and unsaturated aliphatic hydrocarbon groups and such groups optionally substituted by one or more aromatic, cycloaliphatic, or heterocyclic group(s). Suitable examples include, but are not limited to, diacylglycerol, dialkylglycerol, N-N-dialkylamino, 1,2-diacyloxy-3-aminopropane, and 1,2-dialkyl-3-aminopropane. In some embodiments, the nucleic acid-lipid particle comprises: (a) a nucleic acid (e.g., an interfering RNA); (b) a cationic lipid comprising from about 50 mol % to about 65 mol % of the total lipid present in the particle; (c) a non-cationic lipid comprising from ~25 mol %-45 mol % of the total lipid present in the particle; and (d) a conjugated lipid that inhibits aggregation of particles comprising from ~5 mol %-10 mol % of the total lipid present in the particle.

In some embodiments, the nucleic acid-lipid particle comprises: (a) a nucleic acid (e.g., an interfering RNA); (b) a cationic lipid comprising from about 50 mol % to about 60 mol % of the total lipid present in the particle; (c) a mixture of a phospholipid and cholesterol or a derivative thereof comprising from about 35 mol % to about 45 mol % of the total lipid present in the particle; and (d) a PEG-lipid conjugate comprising from about 5 mol % to about 10 mol % of the total lipid present in the particle.

In some embodiments, the nucleic acid-lipid particle comprises: (a) a nucleic acid (e.g., an interfering RNA); (b) a cationic lipid comprising from about 55 mol % to about 65 mol % of the total lipid present in the particle; (c) cholesterol or a derivative thereof comprising from about 30 mol % to about 40 mol % of the total lipid present in the particle; and (d) a PEG-lipid conjugate comprising from about 5 mol % to about 10 mol % of the total lipid present in the particle. In some embodiments, a CRISPR/Cas system can be used for knocking down, such as reducing or suppressing, the expression of PD-L1 and/or PD-1 (SFE WO2015/161276). Exemplary features of CRISPR/Cas systems are described below and can be adapted for use in reducing or suppressing expression of a molecule, rather than disrupting or deleting a gene encoding the molecule, by using an enzymatically inactive nuclease. In some embodiments, a guide RNA (gRNA) targeting a gene encoding PD-L1 or PD-1, such as the CD274 or PDCD1 gene, or the promoter, enhancer or other cis- or trans-acting regulatory regions, can be introduced in combination with a modified Cas9 protein or a fusion protein containing the modified Cas9 protein, to suppress the expression of, e.g., knock-down, of the gene(s). In some embodiments, the Cas9 molecule is an enzymatically inactive Cas9 (eiCas9) molecule, which comprises a mutation, e.g., a point mutation, that causes the Cas9 molecule to be inactive, e.g., a mutation that eliminates or substantially reduces the Cas9 molecule cleavage activity. In aspects, the eiCas9 molecule is fused, directly or indirectly to, a transcription activator or repressor PPT.

One class of adjuvants that has been explored is cationic lipids. Cationic lipids can be easily manufactured and are safe and well tolerated in humans and other animals (Nabel, G. J., et al., Proc Natl. Acad Sci U.S.A., 90:11307-11311 (1993); and Parker, S. E., et al., Hum. Gene Ther., 6:575-590 (1995)). Vaxfectin® is a recently introduced adjuvant for DNA vaccines that consists of an equimolar mixture of the cationic lipid GAP-DMORIE [(±)-N-(3-aminopropyl)-N,N-dimethyl-2,3-bis(cis-9-tetradecenyloxy)-1-propanaminium bromide)] and a neutral colipid DPyPE (1,2-diphytanoyl-sn-glydero-3-phosphoethanolamine) (Hartikka, J., et al., Vaccine, 19:1911-1923 (2001)). Vaxfectin® is dose-sparing, enhances production of antigen-specific antibody in small animals, including virus-neutralizing antibody, and can induce immunity to a variety of infections (Hartikka, J., et al., Vaccine, 19:1911-1923 (2001); Nukuzuma, C., et al., Viral Immunol., 16:183-189 (2003); Hermanson, G., et al., Proc Natl. Acad Sci U.S.A., 101: 13601-13606 (2004); Sedegah, M., et al., Vaccine, 24:1921-1927 (2006); Hahn, U. K., et al., Vaccine, 24:4595-4597 (2006); Margalith, M., et al., Genet. Vaccines. Ther., 4:2 (2006); and Jimenez, G. S., et al., Hum. Vaccin., 3:157-164 (2007)).

i. Material Composition

As exemplified above, CEPESCs can comprise any suitable number of DAs of any suitable composition. In aspects, CEPESCs comprise 2+, 3+, or more DAs associated with SMGAOA of the NAMs of a CEPESC. In aspects, CEPESCs comprise a single type of DA, which can comprise several components of different origins/compositions or a single type of origin (e.g., as in the case of a viral particle in a viral vector). In aspects, CEPESCs comprise solid nanoparticle(s). In aspects, CEPESCs comprise liposome DA(s), which in aspect(s) also are nanoparticle(s) (however, some liposomes are microparticles, such as monophosphoryl lipid A (MPLA), phospholpipid:cholesterol, or phosphotidylcholine:cholesterol liposomes). In aspects, CEPESCs comprise VLP DAs. In aspects, CEPESCs comprise polymeric DAs (e.g., Poly(lactide-co-glycolide) (PLGA), Poly(lactic acid) (PLA), or chitosan polymers). Examples of such PDA/DA materials include CTAB-PLG particles. (SFE Intl Application Number PCT/US99/17308). In aspects, DAs comprise inorganic nanoparticles (e.g., gold nanoparticles silica nanoparticles, or CaPNP(s). In aspects, DAs PC, GCO, SCO or CO of CaPNP(s).

PDAs can comprise, primarily comprise, GCO, or CO dendrimers, lipids, liposomes (e.g., unilamellar or multilammelar vesicles (including those composed of biodegradable phospholipids such as phosphatidylserine, phosphatidylcholine, and/or cholesterol), or proteins. In aspects, DAs comprise small unilamellar vesicles (SUVs) or large unilamellar vesicles (LUVs). In aspects, DAs comprise collagen, chitosan, hyaluronic acid, or a polymer, such as for example a homopolymer or a copolymer, e.g., those DEH (e.g., PLGA polymers). Use of PLGA polymers to deliver compositions to DCs adaptable to AOTI is described in Jilek et al., Adv Drug Deliv Rev. 2005 Jan. 10; 57(3):377-90. In aspects, liposomes are cationic, comprising, e.g., imidazolium derivatives (WO95/14380), guanidine derivatives (WO95/14381), phosphatidyl choline derivatives (WO95/35301), piperazine derivatives (WO95/14651), or biguanide derivatives. Liposome compositions and methods adaptable to AOTI are provided in, e.g., Hug and Sleight, Biochim. Biophys. Acta. (1991) 1097:1-17; Straubinger et al., in Methods of Enzymology (1983), Vol. 101, pp. 512-527. Lipsome materials designed for NAM/NAV transfection are commercially available (e.g., Lipofectin™).

PDAs can comprise calcium compounds, such as for example calcium sulfates, or calcium phosphates (e.g., calcium phosphate, such as for example amorphous calcium phosphate, as primary particle materials, coating agents, or both. In AOTI, DAs of CEPESCs PCGCOSCO or CO calcium phosphate particles having greater than 75% amorphous content, e.g., greater than about 80%, ≥~85%, ≥~90%, or even greater, e.g., ≥~95% amorphous content), crystalline or poorly crystalline apatitic calcium phosphate (e.g., a calcium phosphate comprising a synthetic material not necessarily restricted to 1 calcium phosphate phase), dicalcium phosphate dihydrate, tricalcium phosphate, tetracalcium phosphate, monetite, monocalcium phosphate monohydrate, octacalcium phosphates, hydroxyapatites, or carbonated or otherwise substituted/modified versions of such calcium phosphates). Aspects of these and other calcium-based DAs adaptable to CEPESCs are described in WO00/15194; He Q et al. Clin Diagn Lab Immunol. 2000 November; 7(6):899-903; Temchura V V et al. Biomaterials. 2014 July; 35(23):6098-105; U.S. Pat. No. 8,309,134B2; Amini Y, et al Biotechnol Bioprocess Eng. (2016) 21:653-8; WO00/46147, Benvenisty et al (1986) PNAS 83:9551-55, Wigler et al. (1978), Cell 14:725, & Coraro et al. (1981) Somatic Cell Genetics 7:603).

In aspects, CEPESCs comprise CaPNP nanoparticles. In aspects, the only TFAs in the CEPESC are the CaPNPs or materials associated directly with the CaPNPs (e.g., functionalizing agents). In aspects, CEPESCs comprise functionalized CaPNP(s). Functionalizing agents associated with CaPNP(s) comprise lipids, polycations, polyanions, citrates, and compositions. Examples of functionalizing agents include polyethyleneimine, poly-lysine, and combinations. Additional examples of such AOTI are DEH & U.S. Pat. No. 8,309,134.

In aspects the materials that make up DAs are non-toxic. In aspects, most, generally all, substantially all, or all of such materials are biodegradable in TR cells. Biodegradable DAs are known. E.g., biodegradable polymers for NAM delivery adaptable to AOTI are described in Thomas T J, et al. *Molecules*. 2019; 24(20):3744. A specific example of such materials are biodegradable poly(ortho ester) materials, SFE Wang et al., *Nat. Mater.*, 2004; 3(3):190-6.

Nanoparticle DAs can comprise coating compositions that can facilitate stability, transfection, targeting, etc. E.g., a coating composition can comprise a molar ratio of ~20-60% cationic lipid; ~5-25% non-cationic lipid; about 25-55% sterol; and 0.5-15% PEG-modified lipid. Examples of cationic lipids include 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy) heptadecanedioate. In aspects, CEPESCs comprise cationic lipid(s) that are ionizable. In aspects, CEPESCs comprise non-cationic lipid(s) that are neutral lipid(s). In aspects, CEPESC(s) comprise a cholesterol sterol component. Examples of cationic lipid DAs are described in US20200038499.

In aspects, DAs comprise polyethylenimine (PEI) particles, e.g., in which NAMs are bound through condensation. Examples of such DAs, including targeted DAs comprising PEI particles, adaptable to AOTI are discussed in Pandey A P et al. *Mater Sci Eng C Mater Biol/Appl*. 2016; 68:904-918.

In aspects, DAs comprise biodegradable polyethyleneimine-functionalized polyhydroxybutyrate nanoparticles (PHB-PEI NPs). Examples of such particles adaptable to AOTI are described in Conte R et al. *Int J Mol Sci.* 2020; 21(3):869. Published 2020 Jan. 29.

In aspects, PDAs are magnetic particles. In aspects, PDAs are carbon-based particles. In aspects, PDAs are carbon magnetic particles. Examples of such particles are described in, e.g., U.S. Pat. No. 9,107,858.

In AOTI, TFA(s) comprises calcium phosphate nanoparticles (CaPNPs). In AOTI, CaPNP(s) are multi-layer CaPNP (s). In aspects, the composition comprises a multi-layer CaPNP structure comprising a CaPNP core and at least one CaPNP outer layer that encompasses one or more NAM(s).

iii. Size Characteristics

In aspects, most, generally all, substantially all, or all of the DAs/PDAs of a CEPESC are sized such that the composition and accompanying NAM(s) can be taken up by ICs, e.g., macrophages, DCs, NKCs, T-cells, or combination(s). Also or alternatively, a delivery system can have an average size or a maximum size such that the CEPESC can be delivered by an intramuscular injection using standard sized injection needle(s).

In aspects, CEPESC(s) comprise DA(s) less than 2 microns in size. In aspects, CEPESC(s) comprise, primarily comprise, generally comprise, or only comprise nanoparticle-sized DA(s). Nanoparticle DA(s) are made of pharmaceutically suitable materials that enhance cellular uptake of NAM(s) and that on average, in maximum diameter, or both, are less than 1 micron in size (or that are generally, substantially only, or only less than 1 microns in size). In aspects PDAs PCGCOSCO or CO PDAs of less than 0.7 microns, less than 0.5 microns, or less than 0.4 microns in size. In aspects, PDAs are on average, generally, substantially only, or only, less than 0.35 microns or 0.25 microns in size (e.g., 5-350 nm, such as 50-300 nm, e.g., 100-250 nm, 150-225 nm, or 180-215 nm). In aspects, DAs, such as PDAs are less than about 0.15 microns, less than about 0.1 microns, less than about 0.05 microns, less than 0.025 microns, or less than 0.01 microns in average size or maximum size.

According to certain embodiments, the nanoparticles of a delivery mechanism have an average diameter of less than 300 nm in any one direction in size ("diameter" as used herein being used to describe the largest dimension of a nanoparticle used for or used as part of a delivery mechanism even if the nanoparticle is not exactly spherical), such as for example less than about 250 nm in diameter, less than about 225 nm in diameter, less than about 200 nm in diameter, less than about 175 nm in diameter, less than about 150 nm in diameter, or less than about 125 nm in diameter, such as less than about 100 nm, less than about 75 nm, less than about 50 nm, or less than about 25 nm in diameter, such as for example having an average diameter of between about 10 nm and about 200 nm, between about 25 nm and about 175 nm, between about 50 nm and about 150 nm, such as between about 75 nm and about 125 nm. In some aspects, a nanoparticle delivery mechanism can comprise a nanoparticle having an average size of less than 10 nm, such as about 10 nm, about 8 nm, about 6 nm, about 4 nm, or about 2 nm.

In aspects, PDA(s) have a mean or maximum diameter of from about 30 nm to about 150 nm, from about 40 nm to about 150 nm, from about 50 nm to about 150 nm, from about 60 nm to about 130 nm, from about 70 nm to about 110 nm, from about 70 nm to about 100 nm, from about 80 nm to about 100 nm, from about 90 nm to about 100 nm, from about 70 to about 90 nm, from about 80 nm to about 90 nm, from about 70 nm to about 80 nm, or about 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm.

In some aspects, the nanoparticle is sized to be capable of being DOS phagocytized by ICs, such as ITIC(s), e.g., macrophage(s), in TR(s).

iii. Physical Characteristics of PDA/DAs

In AOTI, PDAs comprise, PC, GCO, or CO solid PDA(s). In aspects, NAM(s) are contained in such PDA(s). In aspects, NAM(s) are conjugated to part of such PDA(s). In aspects, NAM(s) are bound to most, generally all, or all of the surface of such PDA(s) or areas intended to be associated with NAM(s) (NAM-associated area(s) that make up less than all of the PDA.

In aspects, PDA(s) comprise a layered design, such as several bioresorbable layers, with NDA(s) contained in one or more layers allowing for sustained or modulated release of NAM(s). In aspects, each such layer comprises a different amount of NAM(s), different types of NAM(s), or both. In certain aspects, such a layered design allows for multiple doses of an accompanying active, such as the compositions described herein. In aspects, layers of PDAs have the same resorption rate. In aspects, layers of layered PDA(s) have different resorption rates.

In aspects, PDAs have defined crystallinity characteristics and/or crystal size. The crystallinity of the material of which the nanoparticle is comprised can be any crystallinity suitable for providing the desirable characteristics of composition delivery. The crystallinity and/or crystal size of a given nanoparticle delivery mechanism DOS impact the dissolution or resorption rate of the PDA. In aspects, PDAs comprise non-crystalline or poorly crystalline material(s). Examples of a highly crystalline material suitable for the present invention is a hydroxyapatite, such a highly crystalline material being weakly resorbable. Examples of a material comprising a less crystalline structure include more amorphous calcium phosphates.

PDA(s) can have any suitable shape(s). In aspects, PDA(s) are generally spherical in shape, that is, for example, varying in diameter in any two directions by no more than approximately 50%, such as no more than about 50%, no more than about 45%, no more than about 40%, no more than about 35%, no more than about 30%, no more than about 25%, no more than 20%, or for example by no more than about 15%, no more than about 10%, or for example by no more than about 5%. In aspects, PDA(s) have an average diameter standard deviation of no more than 25% of the average diameter, such as for example no more than about 25%, no more than about 20%, no more than about 15%, no more than about 10%, or for example no more than about 5% of the average diameter. In aspects, PDAs are mostly or generally spherical in shape yet the total population of nanoparticles present in the administered formulation can comprise PDAs of significantly disparate shapes or sizes, such as for example the total population of PDAs having an average diameter standard deviation of more than 25% of the average diameter, such as for example more than about 25%, more than about 30%, more than about 35%, more than about 40%, more than about 45%, more than about 50%, more than about 55%, more than about 60%, more than about 65%, more than about 70%, more than about 75%, more than about 80%, more than about 85%, more than about 90%, more than about 95%, or even more, such as for example even more than 100%. In aspects, PDAs comprise, generally comprise, or consist of particles having a non-spherical shape, e.g., having a disc-like (e.g. somewhat circular and flat) or needle-like shape.

In aspects, PDAs have a smooth surface or a rough surface. In aspects, PDA(s) have a rough surface that DOS induces IR(s). A rough surface can comprise an incongruent, non-smooth, or varied the surface, for example the surface having areas of increased height or increased depth in some or many areas, as in for example caused by an etching process).

In aspects, PDAs are porous. In aspects, porous PDA(s) have a specific minimum, average, or maximum porosity. In aspects, the porosity of PDA(s) DOS enhances resorption of the PDA(s). Porosity characteristics of nanoparticles adaptable to such AOTI are described in WO20000015194.

In aspects, SMGAOA PDAs of CEPESCs are mostly, generally, or only composed of materials that are bioresorbable (or "resorbable")—i.e., materials capable of generally or entirely dissolving or being absorbed by the TR tissue(s) within suitable periods of time, e.g., before the occurrence of DOS instances of PDA-associated granulomas. In aspects, PDAs are substantially or completely bioabsorbed to non-detectable levels within 2 months, within 1 month, or less, e.g., 1-24 days, or 1-14 days, 1-10 days, or 1-8 days.

iv. Functional Properties

In aspects, PDAs are suitable for administration according to intended delivery methods, such as intramuscular injection, mucosal administration, or other suitable method. In aspects, PDA(s) do not lead to a rapid uptake of the nanoparticles by the reticuloendothelial system (RES), preventing the compositions from reaching targeted cells. In aspects, PDA(s) DOS induce uptake of associated NAM(s) into cells (e.g., target cell(s)), release of NAM(s) into the cytoplasm, uptake of NAM(s) into the nucleus, protection/stability of the NAM(s), expression of the NAM(s), and induction of IR(s). In aspects, CEPESCs do not DOS induce formation of granuloma(s). do not DOS impair quality of tissue (e.g., muscle), or both. In aspects, CEPESCs are DOS transfected in APCs (e.g., DCs). In aspects, CEPESC(s) are shelf-stable for significant periods of time under typical storage conditions, e.g., at RT or ambient temperatures (e.g., 10-50 or 10-40 degrees C. & 40-80% relative humidity). Such CEPESCs do not require cold chain storage to be effective.

In aspects, PDA(s) comprise material(s) or composition(s) that effectively target particular cells, such as IC(s), e.g., ITIC(s), e.g., DCs. A PDA can comprise one or more ligands for cellular targets. E.g., a PLGA polymer composition can comprise Toll like receptor (TLR) 3 and 7 ligands, was then targeted to distinct DC cell-surface molecules. Such compositions are exemplified in Cruz L J et al. J Control Release. 2014; 192:209-218. Compositions comprising DC-targeting ligands (e.g., DEC-205 ligands) that can be adapted to PDA/DA compositions are described in US 2013/0142864 & WO2005018610 and Saluja S S et al. Int J Nanomedicine. 2014; 9:5231-5246.

In aspects, DAs/PDAs have adjuvant properties (DOS enhancing IR(s) induced by antigen(s), inducing non-specific IR(s), or both). E.g., in aspects, PDAs comprise, generally consist of, or consist of calcium phosphate nanoparticles that independently DOS induce IR(s), such as, e.g., B cell IR(s), T-cell IR(s), or both. Other types of PDAs with adjuvant properties are DEH.

iv. Concentration Characteristics

PCA(s) and NAM(s) of CEPESCs can be present in any suitable concentration/relationship. In AOTI, the density of PDA(s) in the CEPESC DOS enhances adherence, attachment, or encompassing of the CEPES NAM(s). In AOTI, density of PDAs, such as CaPNPs is between ~2 g/cm$^3$ and ~4 g/cm$^3$, e.g., about 2.2, 2.6, 2.8, 3, 3.25, 3.5, or 3.6 and 3.8, 4, 4.25, 4.5, or 5 g/cm$^3$.

In aspects, most, generally all, or substantially all PDAs in a formulation do not DOS agglomerate. In aspects, about 50% or more (e.g., 60%, 75%, 90% or more) of PDAs remain suspended after 20 hours, 40 hours, 72 hours, 96 hours, or 120 hours or more.

The amount of NAM(s) in the composition will be amounts that are expected or demonstrated to be effective in inducing CE(s) in intended TR(s) and, accordingly, will vary based on the nature of the NAM(s) (e.g., composition, coding sequences, etc.), nature of PDAs and other CEPESC components, the intended TR recipients (e.g., in terms of metabolism, weight, etc.), and the like. In general, the amount of NAM(s) will be an amount that is expected or demonstrated (e.g., through one or more preclinical studies, clinical studies, or both, in TR(s)) to DOS induce IR(s), DOS induce CE(s), or to be considered to treat or prevent a DCA-associated condition/disease. In general, the amount of NAMs can be similar to those effectively used for induction of IR(s) or CE(s) in corresponding vector systems used in the art, as exemplified/described elsewhere herein and in various references DEH (use of NAVs as DNA vaccines, e.g., is reviewed in Liu et al. (2011), Immunol Rev. 239(1): 62-84). In aspects, NAM(s) are present in a concentration about 1 pg to about 10 mg (e.g., about 5 pg to about 10 mg, about 5 pg to about 5 mg, about 1 mg to about 5 mg, about 1 pg to about 2 mg, about 1 pg to about 1 mg, about 1 pg to about 500 pg, ~1 pg to ~100 pg, about 1 pg to about 50 pg, or ~1 pg to ~10 pg, e.g., ~5-100 pg, e.g., ~5-75, 2-50, 2-40, or 2.5-25 pg. In aspects, NAM(s) are present in a volume of about 0.25 mL, about 0.5 mL, 0.75 mL, about 1 mL, or about 2 ML (e.g., 0.1-3, 0.2-2.6, 0.25-2.5 mL).

Viral vectors compositions can comprise any suitable number of particles and any suitable concentration of such particles. Examples of concentrations/amounts of such particles that are suitable are DEH and in various references incorporated herein. In aspects, viral vectors comprise at least about $1\times10^3$ viral vector particles in a volume of about 1 mL (e.g., at least about $1\times10^3$ to about $1\times10^8$ particles in about 1 mL). In aspects, viral vectors are present in an amount of at least about $1\times10^6$, about $1\times10^7$, about $1\times10^8$, about $1\times10^9$, or more particles/mL).

In aspects, CEPESCs comprise NAM(s) and PDA(s) in NAM/PDA ratio of about 1:1 to about 1:40, e.g., about 1:2 to about 1:20, e.g., about 1:3 to about 1:12, about 1:2 to about 1:12, about 1:3 to about 1:9, about 1:2 to about 1:8, about 1:3 to about 1:6, about 1:1 to about 1:5, about 1:2 to about 1:5, or about 1:3 to about 1:5. E.g., CEPESCs can comprise about 0.5-500 micrograms NAM and about 0.5-10,000 micrograms PDA, such as about 1-5,000 micrograms PDA, e.g., about 1.5-3000 micrograms PDA, about 1.75-3000 micrograms PDA, or about 2-2000 micrograms PDA, e.g., CaPNP.

v. Functionalization

PDAs/DAS can be non-functionalized or functionalized (e.g., can have further elements such as molecules attached to them to aid in their function). E.g., PDA/DA materials can be functionalized with polycation, polyanion, or lipid attached, e.g., on the surface of the PDA/DA. Functional group(s)/composition(s) can be AW the rest of a PDA (e.g., a core particle) by any suitable means, including, e.g., electrostatic association, hydrogen bonding, dipole-dipole interaction, and/or van der Waals-type forces. In some aspects, PDAs such as calcium phosphate nanoparticles can be functionalized with substances such as but not limited to lipids, polycations, polyanions, or citrate. In certain aspects, a functionalized nanoparticle can be charged.

PDAs can incorporate resorption factor(s) DOS impacting the rate at which the nanoparticles are absorbed. Such resorption factors can be any biologically compatible or inert factor capable of modifying the resorption time of the PDA/nanoparticle. Such factors may be attraction factors, such as those which attract phagocytic or osteogenic cells, or such factors may be inhibitory factors, such as phagocytic cell activity inhibitors. Exemplary attraction factors can include but may not be limited to interleukin-1, lymphotoxin, or calcitonin. Exemplary inhibitory factors can include but may not be limited to neutral phosphate, glucocorticoids, plicamycin, gallium nitrate. Such resorption factors may, in certain embodiments, be adjuvants. According to certain embodiments, the compositions described herein are delivered to a recipient using a nanoparticle delivery mechanism having one or more resorption factors incorporated therein or thereon.

In AOTI, PDAs are functionalized with polycations. Such polycations can be any polymeric-type molecule capable of providing a net cationic charge to the nanoparticles. Such net cationic charge can reduce nanoparticle agglomeration and/or aid in attachment of an active. In AOTI, the charge associated with the net cationic charge to the nanoparticle is associated with the main cationic polymer chain. In AOTI, the charge associated with the net cationic charge to the nanoparticle is associated with one or more side chains of the cationic polymer chain. In aspects, charge(s) can be associated with both the main cationic polymer chain and one or more side chains.

In AOTI, a cationic polymer serving to functionalize the nanoparticle delivery mechanism can have a molecular weight of less than 20,000 kD, e.g., less than about 18,000 kD, less than about 16,000 kD, less than about 14,000 kD, less than about 12,000 kD, or less than about 10,000 kD, such as for example less than approximately 8,000 kD, less than approximately 6,000 kD, less than approximately 4,000 kD, or for example even less, such as less than approximately 2,000 kD. In some aspects, any one or more side chains of the main cationic polymer chain has a molecular weight or degree of polymerization that is less than the main chain from which it extends.

According to aspects, polycation functionalizing agents can include but may not be limited to polyethyleneimine (PEI), PEI in some aspects being a branched polymer having about 20-30% primary amine groups, 40-60% secondary amine groups, and 20-30% tertiary amine groups; polyamines; polylysine, e.g., having about 25 to about 30 L-Lysine repeating units); cationic oligopeptide polymers, e.g., macromolecules containing between 2-12 amino acid repeating units; polyarginine; protamines; and/or diethylaminoethyl-dextran (DEAE-dextran); or any other similar or equivalent such polycations sufficient to provide the desired delivery mechanism characteristics of the composition such as means of administration, dissolution time, and/or for example, characteristics such as composition stability.

In AOTI, PDAs, e.g., nanoparticles, can be functionalized with polyanions. Such polyanions can be any polymeric-type molecule capable of providing a net anionic charge to nanoparticles. Such net anionic charge can reduce nanoparticle agglomeration and/or aid in attachment of an active. In aspects, the charge associated with the net anionic charge to the nanoparticle is associated with the main anionic polymer chain. In aspects, the charge associated with the net anionic charge to the nanoparticle is associated with one or more side chains of the anionic polymer chain. In aspects, the charge can be associated with both the main anionic polymer chain & 1+ side chains.

In aspects, an anionic polymer serving to functionalize a PDA has a molecular weight of less than 20,000 kD, such as for example less than about 20,000 kD, less than about 18,000 kD, less than about 16,000 kD, less than about 14,000 kD, less than about 12,000 kD, or less than about 10,000 kD, such as for example less than approximately 8,000 kD, less than approximately 6,000 kD, less than approximately 4,000 kD, or for example even less, such as less than approximately 2,000 kD. In some aspects, any one or more side chains of the main anionic polymer chain has a molecular weight or degree of polymerization that is less than the main chain from which it extends.

In aspects, polyanion functionalizing agent(s) can include but may not be limited to polyacrylic acid (PAA); polyglutamic acid; anionic oligopeptide polymers, e.g., anionic oligopeptide polymers having molecular weights of less than or equal to 10,000 kD, such as for example less than about 9,000 kD, less than about 8,000 kD, less than about 7,000 kD, less than about 6,000 kD, or less than about 5,000 kD, such as for example less than approximately 4,000 kD, less than approximately 3,000 kD, or even approximately 2,000 kD or less); poly(aspartic acid); polyethyleneglycol-b-poly (aspartic acid) copolymer; polypropylacrylic acid; or any other similar or equivalent such polyanions sufficient to provide the desired delivery mechanism characteristics of the composition such as means of administration, dissolution time, or, e.g., characteristics such as composition stability.

In aspects, PDAs are functionalized with lipid(s). In aspects, such lipid(s) DOS aids in the ability of NAM(s) to adhere to PDA(s) (e.g., maintain attachment with or remain bonded to a nanoparticle) until such time that it is appropriate for the compositions of the present invention to be digested, removed, or otherwise disengaged from, the nanoparticle. The lipid used to functionalize the nanoparticles can be any suitable biologically compatible lipid capable of providing a desired level of adherence of the compositional elements of the compositions described herein and the delivery mechanism.

Charge and Zeta Potential Characteristics

PDAs/CEPESCs can have any suitable charge characteristics. In aspects, the amount of charge associated with PDAs/DAs/nanoparticles can be intentionally varied using known techniques in the art. Such an amount of charge can be any suitable amount of charge so as to yield nanoparticles having a desired amount of binding ability to an associated active, a desired amount of agglomeration (or lack thereof), or both a target level of binding ability & agglomeration. In aspects, polycations or polyanions can be prepared with a charge on 1-99% of the repeating units of a PDA polymer, such as for example between about 1-90%, between about 1-80%, between about 1-70%, between about 1-60%, between about 1-50%, between about 1-40%, between about 1-30%, between about 1-20%, or between about 1-10%, such as e.g., between about 10-99%, between about 20-99%, between about 30-99%, between about 40-99%, between about 50-99%, between about 60-99%, between about 70-99%, between about 80-99%, or for example between about 9-99% of the repeating units of the polymer carrying a charge, as in for example between approximately 5-20%, between approximately 30-70%, or between approximately 40-60% of repeating polymer units carrying a charge.

In aspects, a PDA(s)/CEPESCs comprise a zeta potential of between about −50 to about 50 millivolts, such as for example between about −70 to about 70 millivolts, between about −70 to about 60 millivolts, between about −70 to about 50 millivolts, between about −70 to about 40 millivolts, between about −70 to about 30 millivolts, between about −70 to about 20 millivolts, between about −70 to about 10 millivolts, or for example between about −70 to about 0 millivolts, e.g., between approximately −60 to about 70 millivolts, between approximately −50 to about 70 millivolts, between approximately −40 to about 70 millivolts, between approximately −30 to about 70 millivolts, between approximately −20 to about 70 millivolts, between approximately −10 to about 70 millivolts, or between for example between approximately 0-70 millivolts, as in for example between about −60 to about 60 millivolts, between about −50 to about 50 millivolts, between about −40 to about 40 millivolts, between about −30 to about 30 millivolts, between about −20 to about 20 millivolts, or for example between about −10 to about 10 millivolts.

2. Formulations

CEPESCs typically contain excipient(s) in addition to NAM(s), and any present additional vector component(s) (e.g., cellular vectors) or DA(s)/TFA(s). "Excipients" here means any intended, pharmaceutically acceptable component of a CEPESC that is not (1) any NAM(s) comprising EPES(s), (2) an active pharmaceutical ingredient (API); (3) a part of a vector; (4) a DA/TFA; and (5) an adjuvant (a substance that induces non-Ag specific IR(s) or that generally enhances IR(s)).

Excipients can either be classified as functional excipients, which impart/exert detectable and specific functions to/on the CEPESC (e.g., preservative, stabilizer, antioxidant, surfactant, chelating agent, isotonicifier, anesthetic, or buffer) and nonfunctional excipients, that are inert carriers or bulking agents (e.g., materials classified as diluents, carriers, and the like, such as water, solutions, etc.). Excipients are present in suitable and effective amounts. Effective amounts WRT functional excipients means an amount that suitably or optimally performs the intended function in the CEPESC (e.g., achieving a pH that is optimal for injection of the CEPESC into TR(s) and subsequent delivery of the CEPESCs to cells). Excipients and other components of CEPESCs typically are compatible with the other ingredients of the formulation, and not injurious to the subject (e.g., not associated with DOS adverse event(s) in TR population(s), e.g., as determined in clinical studies). Excipients and other component(s) DOS do not reduce the storage of the CEPESC under intended storage conditions, such as those DEH, and in storage and formulation steps (if any). CEPESCs can be in ready-for-use (RFU) form or a form that requires step(s) to prepare a RFU CEPESC (such AOTI are DEH). Excipients and other components of CEPESCs are typically adapted for and suitable for use in the intended delivery route of the CEPESC (e.g., by injection, such as subcutaneous injection, intradermal injection, or intramuscular injection; by mucosal delivery; by inhalation; by biolistic injection; or by oral administration). E.g., biolistic delivery systems comprising PDAs are described in, e.g., WO 99/2796, WO 99/08689, WO 99/04009, and WO 98/10750, and U.S. Pat. Nos. 5,525,510, 5,630,796, 5,865,796, 6,010,478, 4,945,050; 5,036,006; 5,100,792; and 5,179,022; 5,371,015; and 5,478,744 & related needle-less injection systems (Davis, H. L., et al, Vaccine 12:1503-1509, 1994).

Transfection facilitating agents/compounds suitable in formulations include inorganic materials such as calcium phosphate, alum (aluminum sulfate), and gold particles (e.g., "powder" type delivery vehicles); peptides that are, for example, cationic, intercell targeting (for selective delivery to certain cell types), intracell targeting (for nuclear localization or endosomal escape), and ampipathic (helix forming or pore forming); proteins that are, for example, basic (e.g., positively charged) such as histones, targeting (e.g., asialoprotein), viral (e.g., Sendai virus coat protein), and pore-forming; lipids that are, for example, cationic (e.g., DMRIE, DOSPA, DC-Chol), basic (e.g., steryl amine), neutral (e.g., cholesterol), anionic (e.g., phosphatidyl serine), and zwitterionic (e.g., DOPE, DOPC); and polymers such as dendrimers, star-polymers, "homogenous" poly-amino acids (e.g., poly-lysine, poly-arginine), "heterogeneous" poly-amino acids (e.g., mixtures of lysine & glycine), co-polymers, polyvinylpyrrolidinone (PVP), poloxamers (e.g. CRL 1005) and polyethylene glycol (PEG). A transfection facilitating material can be used alone or in combination with one or more other transfection facilitating materials. Two or more transfection facilitating materials can be combined by chemical bonds (e.g., covalent and ionic such as in lipidated polylysine, PEGylated polylysine) (Toncheva, et al, Biochim. Biophys. Acta 1380(3):354-368 (1988)), mechanical mixing (e.g., free moving materials in liquid or solid phase such as "polylysine+cationic lipids") (Gao and Huang, Biochemistry 35:1027-1036 (1996); Trubetskoy, et al., Biochem. Biophys. Acta 1131:311-313 (1992)), and aggregation (e.g., co-precipitation, gel forming such as in cationic lipids+poly-lactide, and polylysine+gelatin).

In aspects, CEPESC(s) comprise excipient(s), PDA(s), or both that provide modified release characteristics, such as delayed release, sustained release, or both. In aspects, CEPESC(s) lack any delayed release characteristic(s)/component(s). NAM(s) of CEPESC(s) typically are isolated, except for any intended conjugated or otherwise associated PDA(s), prior to formulation with excipient(s) in the CEPESC. Carriers for injection include water for injection, PBS, aqueous dextrose solutions, glycerol solutions, and other suitable sterile solution(s). Excipients typically are metabolized by TR(s) rapidly without DOS lasting presence or physiological effect(s) in TR(s). CEPESCs can be in any suitable form, such as solutions, suspensions, gels, emulsions, or dry particle compositions. Formulations for injection typically exhibit pH and isotonicity/buffering characteristics that do not result in DOS AEs when delivered. Excipients and other components of CEPESCs typically can be characterized as being sterile, pyrogen free and particulate free. In aspects, CEPESCs are isotonic (e.g., an isotonic solution) or comprise agents that DOS enhance isotonicity (e.g., sodium chloride, dextrose, mannitol, sorbitol, PBS or lactose). Buffers that can be in CEPESCs include PBS, saline, Tris buffer(s), and sodium phosphate (e.g., about 150 mM sodium phosphate). In aspects, CEPESCs comprise vasoconstriction agent(s). CEPESCs can comprise stabilizer(s), e.g., gelatin or albumin. In aspects, stabilizers DOS promote stability of the CEPESC, e.g., at RT or ambient temperature(s)/humidity for extended periods of time (e.g., 6-60 months, 12-48 months, or 18-36 months). Examples of such stabilizers include LGS, polycations, and polyanions. In aspects, such materials in PDA(s) also or alternatively afford such properties. Excipients and other components of CEPESC(s) typically do not DOS inhibit the ability of the NAM(s) to express EP(s) and for the EP(s) and components of NAM(s) to induce IR(s) or CE(s). Excipient(s) and other component(s) typically are characterizable as non-toxic, non-carcinogenic, non-teratogenic, non-genotoxic, or non-immunogenic and non-antigenic (except for CCCs, PDAs, etc., which are intended to exhibit adjuvant or other IR-inducing properties, such as vaccines and immunogenic therapeutic CCCs) Excipients and other components typically do not produce DOS AEs, e.g., allergic or similar untoward reaction, such as gastric upset, dizziness and the like, when administered. CEPESCs desirably retain such characteristics even when the same type or similar type of CEPESCs are administered two, three, or more times to a TR. Aspects of formulations adaptable to CEPESCs are described in, e.g., Ansel et al., PHARMACEUTICAL DOSAGE FORMS & DRUG DELIVERY SYSTEMS (e.g., 7th ed. 2000), Martindale, THE EXTRA PHARMACOPEIA (31st edition), Remington's PHARMACEUTICAL SCIENCES (e.g., 16th-20th editions), THE PHARMACOLOGICAL BASIS OF THERAPEUTICS, Goodman and Gilman, Eds. (e.g., 9th ed.—1996), Pashine et al. 2005, Nature Med. 11(4):S63-S68, and U.S. Pat. Nos. 5,708,025, 5,994,106, 6,165,779, 6,225,289, 5,591,601, 5,593,972, 5,679,647, 5,697,901, 5,698,436, 5,739,118, 5,770,580, 5,792,751, 5,804,566, 5,811,406, 5,817,637, 5,830,876, 5,830,877, 5,846,949, 5,849,719, 5,880,103, 5,922,687, 5,981,505, 6,087,341, 6,107,095, and 6,110,898, and WO 98/06863, WO 98/55495, and WO 99/57275. Compositions and methods related to lipofection, nucleofection, biolistics, virosomes, liposomes, immunoliposomes, polycation or lipid:nucleic acid conjugates, artificial virions, cationic or neutral lipids, and agent-enhanced uptake of NAMs adaptable to CEPESC formulations are described in e.g., U.S. Pat. Nos. 5,049,386, 4,946,787; and 4,897,355, WO 91/17424; WO 91/16024. More auxiliary agents for use in compositions of the present invention include non-ionic detergents and surfactants (e.g., Tween, Pluronic, and similar compositions), various salts, excipients, delivery vehicles and/or other auxiliary agents as are disclosed, e.g., in U.S. patent application Publication No. 2002/0019358 and U.S. Pat. No. 8,821,890.

3. Packaged Compositions & "Kits"

Packaged compositions comprising CEPESCs (e.g., CEPESCs in containers, such as injection-ready vials and the like) are AOTI. Kits comprising CEPESCs or components of CEPESCs that can be constituted/reconstituted ("reconstituted"), formulated, combined, mixed, or prepared to obtain CEPESCs or RFU CEPESCs also are an AOTI. As such AOTIs share related properties they are discussed together here. As aspects of kits & packaged compositions applicable to NAM compositions are known in the art this description of such AOTIs is both brief & non-limiting WRT to what is KITA.

"Kits" can comprise any suitable combination of CEPESC components, such as NAM(s), separate NAM compositions for combination, PDA(s) that an be mixed with/reacted with NAM(s), excipients, CCC(s), or combinations. Kits can include instructions, labeling, etc. Kits can also include indicators of purity, stability, etc., and assay(s) for demonstrating potency, purity, or effectiveness (e.g., ELISA components, instructions for performing FACS, qPCR components, etc.). Kits can include indicator(s) of identity, such as RFID tags, and the like. Kits also can include containers for storing kit component(s), mixtures made in processing/making CEPESC(s), and the like. Components can be in dried or liquid form (e.g., NAM(s) can be present in lyophilized, spray dried, or other dried forms, which are an AOTI). Containers can include sealed containers such as ampule or sachet indicating the quantity of component(s) (e.g., water for injection, buffers, and the like). In aspects, kit(s) or packaged composition(s) comprise two or more different types of NAM(s) or two or more different types of CEPESC(s) (e.g., a NAV CEPESC and a viral vector CEPESC or a CEPESC intended for priming IR(s) and a second CEPESC intended for boosting IR(s)). Kit(s) and packaged composition(s) can comprise single-use component(s), reusable component(s), or both. Kit(s) can include and packaged composition(s) can include delivery system component(s)/device(s), e.g., bottles, test tubes, vials, iv bags, pierceable vials, syringes, needles, dispensing pens, biolistic system(s), and the like, or systems for promoting delivery such as for performing electrophoresis. Kits and packaged compositions(s) can include materials used in administration such as alcohol or other wipes, bandages, labels, anesthetics, and the like. E.g., a CEPESC for intramuscular injection can be contained in a kit or packaged composition comprising a standard needle (e.g., a needle with an inner diameter of less than 350 nm, such as a needle with a Birmingham gauge size of 23 or higher, e.g., a 23-34 gauge needle) In aspects, kits comprising such needle(s), vials (containing CEPESC formulations or ready to receive such formulations upon reconstitution of a dried CEPESC formulation so as to make a RFU formulation), and other components are provided. Other kits or packaged compositions can comprise other device(s)/component(s) to aid in any of the various delivery methods DEH, such as electroporation device(s), iontophoresis device(s), biolistic delivery device(s), device(s) for mucosal delivery, needle free injection devices (SFE U.S. Pat. Nos. 5,702,359, 7,245, 963, 7,328,064, & 6,763,264), and the like. Kits and packaged compositions can comprise CEPESCs in unit dosages for delivery (e.g., 2, 3, 4, or more dosage(s) for individual TRs, or 50, 100, 150, 200, 250, 500, or more dosage units for delivery to a population, e.g., a herd of swine, cows, or other livestock NHA(s).

E. Cells and Cellular Production of NAMs

Cells comprising EPES/CEPES NAM(s) reflect another AOTI as are methods of producing such NAM(s) in suitable host cell(s). In aspects, cells comprising EPES/CEPES NAM(s) are eukaryotic cells (cells comprising such NAM(s) can be referred to as "host cells"). In aspects, such cells are fungal cells, e.g., yeast cells (e.g., *S. cerevisiae* cells, *N. crassa*, *P. pastoris* cells, or *H. polymorpha* yeast) or mammalian cells. In aspects, host cells are insect cells such as *Drosophila* and Spodopterafrugiperda cells. In aspects, host cells are prokaryotic cells, such as *E. coli* cells. In aspects, host cells are plant cells. In aspects, host cells are mammalian cells such as COS cells, Chinese hamster ovary (CHO) cells, Vero cells, or cells of well-known mammalian cell line origins such as HeLa, BHK, MDCK, HEK 293, K8 cells, SW-13 cells, MCF7 cells, CV1/EBNA cells, PERC6 cells, NTH-3T3 cells, MRC-5 fibroblast cells, and WI38 cells. Examples of host cell systems adaptable to such AOTI are described in, e.g., U.S. Pat. No. 5,994,106 and WO 95/34671 and Pouwels et al. Cloning Vectors: A Laboratory Manual, Elsevier, N.Y., (1985) and Kaufman, R. J., Large Scale Mammalian Cell Culture, 1990, e.g., pp. 15-69). Any such cells can be transfected with NAM(s) and used to reproduce NAM(s), e.g., NAVs comprising EPES(s). In aspects, host cells can stably maintain NAM(s) for, e.g., at least about 10, 15, 20, 30, 50, 100, 200, or 500 generations. In aspects, the invention provides a recombinant non-human animal or plant comprising EPES NAM(s). In aspects, such a non-human animal or plant is used to produce the CEPESC NAM(S) of a CEPESC of the invention.

F. Polypeptide EPs & PEP Compositions

PPTs expressed from CEPESCs, compositions comprising such PPTs, and the use of such PPTs or compositions, also reflect AOTI. Although not typically expected to be the case in some aspects, the use of a PPT composition expressed from any of the CEPESCs disclosed herein can be preferred to the delivery of CEPESCs comprising EPES NAM(s). In one such aspect, a CEPESC EP PPT is derivatized prior to use (such PPT "derivatives" are briefly discussed below). EP PPTs can be expressed in host cells, purified according to standard methods known in the art (SFE Protein Purification Applications: A Practical Approach (E. L. V. Harris and S. Angal, Eds., 1990)), and either delivered TR(s) in effective amount(s) or formulated in suitable formulations and delivered to TR(s) in effective amounts. Such compositions can comprise any suitable amount and number of such EP PPT(s). PPT vaccine formulations & biotherapeutic formulations are KITA, discussed in references CEH, and such principles, methods, and compositions can be adapted to EP PPT compositions.

A PPT "derivative," which will be understood as a biomolecule modified by chemical modification, such as replacement with a synthetic amino acid or conjugated amino acid, as is described above. Covalent derivatives may be prepared using methods known in the art by, e.g., linking the chemical moieties to functional groups on amino acid side chains or at the N-terminus or C-terminus of a polypeptide. However, in most aspects of the invention it is expected that the polypeptides encoded by the constructs of the invention will be non-derivatized (i.e., not modified by chemical methods apply by human intervention). Thus, outside of any AOTI that relate to polypeptides provided herein, per se, or use of such polypeptides or compositions comprising such polypeptides, derivatives will not be considered to be encompassed within the disclosure of a polypeptide or amino acid sequence. EP PPTs also can include post-translational modification(s) added by operations of COE(s), such as glycosyl groups, lipids, phosphate, acetyl groups, and the like.

G. Combination Products

In aspects, CEPESCs comprise additional API(s), adjuvant(s), or both. Such CEPESCs can be characterized as combination compositions (CCs) and such additional components can be characterized as CC components (CCCs). Numerous examples of CCCs are DEH. In general, CEPES-NAM(s), DA/PDA(s) if present, and excipient(s) if present, can be combined with any suitable number of CCCs, of any suitable type of composition, and such CCCs can be present in any suitable amount(s) in such compositions. In aspects, a composition is intended for prevention or treatment of cancer and CCCs comprise anti-cancer therapeutics, anti-cancer prophylactic agents/vaccines, or both. Numerous examples of such compounds are known and examples are briefly described below. In aspects, a composition is intended for prevention or treatment of a pathogenic DCA, such as a virus. Examples of suitable CCCs for such AOTI also are well known and briefly DEH.

In AOTI, CCCs comprise cells, such as APCs (e.g., DCs), CAR-T cells, or other cellular or cell-derived compositions. Such uses of APCs are described in Martin-Fontecha et al. 2003 J. Exp. Med. 198, 615-621. In aspects, CCCs comprise killed cells or sera, e.g., killed cancer cells. In aspects, CCCs comprise autologous cells, such as autologous APCs (e.g., cancer PPT Ag loaded or pulsed with CAg(s), e.g., DCs pulsed with CAg(s), such as MART-127-35 or MART-1. In AOTI, CCCs/AACs comprise PPT or non-PPT/non-NS CIs, e.g., an anti-PD-1, anti-CTLA4, anti-KIR, anti-CRACC, or anti-PD-L1 Ab, as DEH.

In AOTI, CEPESCs are intended for treatment or prevention of cancer and CCCs comprise chemotherapeutic agent(s) (e.g., carboplatin or paclitaxel), anti-cancer vaccine(s) (including vectors encoding CAg(s)), anti-angiogenesis agents, cytokine(s), checkpoint inhibitors, and the like. Numerous examples of suitable anti-cancer CCCs/AACs are known and are DEH or described in references CEH.

In AOTI, CCCs comprise IMs, such as cytokine(s), or NAMs or vectors encoding CIs. Numerous examples of such possible CCCs are DEH.

In aspects, CCCs comprise nucleic acid molecules, such as vectors, encoding sequences that downregulate the expression of DCA-causing or DCA-promoting agents (e.g., genes that downregulate TR oncogenes, endogenous inhibitory CIs, and the like).

In AOTI, a CEPESC is intended for prevention/treatment of a pathogenic DCA and CCCs comprise antibiotic, antiviral, antiprotozoal, antifungal, or antihelminthic compound(s).

E.g., anti-hepatitis CCCs/AACs can comprise interferon, adefovir dipivoxil, and lamivudine. acyclovir, famciclovir, or ganciclovir. Additional anti-viral agents that can be CCCs/AACs include, but are not limited to, abacavir (ZIAGEN®), abacavir/lamivudine/zidovudine (Trizivir®), aciclovir or acyclovir (CYCLOVIR®, HERPEX®, ACIVIR®, ACIVIRAX®, ZOVIRAX®, ZOVIR®), adefovir (Preveon®, Hepsera), amantadine (SYMMETREL®), amprenavir (AGENERASE®), ampligen, arbidol, atazanavir (REYATAZ®), boceprevir, cidofovir, darunavir (PREZISTA®), delavirdine (RESCRIPTOR®), didanosine (VIDEX®), docosanol (ABREVA®), edoxudine, efavirenz (SUSTIVA®, STOCRIN®), emtricitabine (EMTRIVA®), emtricitabine/tenofovir/efavirenz (ATRIPLA®), enfuvirtide (FUZEON®), entecavir (BARACLUDE®, ENNAVIR®), famciclovir (FAMVIR®), fomivirsen (VITRAVENE®), fosamprenavir (LEXIVA®, TELZIR®), foscarnet (FOSCAVIR®), fosfonet, ganciclovir (CYTOVENE®, CYMEVENE®, VITRASERT®), GS 9137 (ELVITEGRAVIR®), imiquimod (ALDARA®, ZYCLARA®, BESELNA®), indinavir (CRIXIVAN®), inosine, inosine pranobex (IMUNOVIR®), interferon type I, interferon type II, interferon type III, kutapressin (NEXAVIR®), lamivudine (ZEFFIX®, HEPTOVIR®, EPIVIR®), lamivudine/zidovudine (COMBIVIR®), lopinavir, loviride, maraviroc (SELZENTRY®, CELSENTRI®), methisazone, MK-2048, moroxydine, nelfinavir (VIRACEPT®), nevirapine (VIRAMUNE®), oseltamivir (TAMIFLU®), peginterferon alfa-2a (PEGASYS®), penciclovir (DENAVIR®), peramivir, pleconaril, podophyllotoxin (CONDYLOX®), raltegravir (ISENTRESS®), ribavirin (COPEGUs®, REBETOL®, RIBASPHERE®, VILONA® AND VIRAZOLE®), rimantadine (FLUMADINE®), ritonavir (NORVIR®), pyramidine, saquinavir (INVIRASE®, FORTOVASE®), stavudine, tea tree oil (melaleuca oil), tenofovir (VIREAD®), tenofovir/emtricitabine (TRUVADA®), tipranavir (APTIVUS®), trifluridine (VIROPTIC®), tromantadine (VIRU-MERZ®), valaciclovir (VALTREX®), valganciclovir (VALCYTE®), vicriviroc, vidarabine, viramidine, zalcitabine, zanamivir (RELENZA®), and zidovudine (azidothymidine (AZT), RETROVIR®, RETROVIS®).

Exemplary anti-fungal agents, anti-bacterial agents, anti-protozoan agents, anti-parasitic agents, that can be incorporated as CCCs/AACs are described in similar levels of detail in, e.g., US20170065675 and U.S. Pat. No. 9,676,856.

In aspects, CCCs/AACs comprise immunomodulators, such as non-peptidic IMs, e.g., synthetic imidazoquinolines such as imiquimod and resiquimod; schiff bases of carbonyls and amines that are constitutively expressed on antigen presenting cell and T-cell surfaces, such as tucaresol (Rhodes, J. et al. 'Therapeutic potentiation of the immune system by costimulatory Schiff-base-forming drugs', Nature 377: 71-75 (1995)), synthetic lipid based adjuvants, such as vaxfectin, (Reyes et al., 'Vaccine 19: 3778-3786), squalene, alpha-tocopherol, endotoxin, [LPS], Beutler, B., 'Endotoxin, 'Toll-like receptor 4, and the afferent limb of innate immunity', Current Opinion in Microbiology 3: 23-30 (2000)); CpG oligo- and di-nucleotides (SFE Sato, Y. et al., Science 273 (5273): 352-354 (1996); and TLR(s)/TLR ligand(s) (SFE Hemmi, H. et al., Nature 408: 740-745, (2000)).

In aspects, CCCs or AACs comprise one or more vaccines, e.g., PPT vaccines, inactivated virus vaccines, partial virus vaccines, or DNA vaccines, which are AAW CEPESCs. Vaccines are known in the art and described in several references CEH. In general, a "vaccine" refers to a composition, for example, a substance or preparation that stimulates, induces, causes or improves immunity in an organism, and typically provides immunity against one or more diseases or disorders in the organism, including prophylactic and/or therapeutic immunity. Exemplary anti-pathogen vaccines include one or more agents that resembles an infectious agent, e.g., a disease-causing microorganism, and can be made, for example, from live, attenuated, modified, weakened or killed forms of disease-causing microorganisms, or antigens derived therefrom, including combinations of antigenic components. In exemplary embodiments, a vaccine stimulates, induces causes or improves immunity in an organism or causes or mimics infection in the organism without inducing any disease or disorder. A vaccine introduces an antigen into the tissues, extracellular space or cells of a subject and elicits an immune response, thereby protecting the subject from a particular disease or pathogen infection. Nucleic acid vaccines can encode antigen(s) and when the polynucleotides are expressed in cells, a desired IR is obtained.

In aspects, CCCs induce a predominantly or generally only Th1-type response include, for example, a Lipid A derivative such as monophosphoryl lipid A, or 3-de-O-acylated monophosphoryl lipid A (SFE U.S. Pat. Nos. 4,436, 727; 4,877,611; 4,866,034 and 4,912,094), CpG-containing oligonucleotides (SFE WO 96/02555, WO 99/33488 and U.S. Pat. Nos. 6,008,200 and 5,856,462), a saponin, such as Quil A, or derivatives thereof, including QS21 and QS7 (Aquila Biopharmaceuticals Inc., Framingham, Mass.); Escin; Digitonin; or *Gypsophila* or *Chenopodium quinoa* saponins.

1. Adjuvant CCCs/AACs

In aspects, CCCs/AACs are adjuvant(s). Adjuvant(s) induce non-Ag-specific IR(s) or enhance other IR(s) in TR(s). Numerous examples of adjuvants are DEH and the category overlaps with many other categories of compositions discussed under other headings in this disclosure. CEPESCs can comprise or be administered with any suitable number, type, and amount of adjuvant(s). Generally, adjuvant(s) can be any composition that DOS increases the expression of EPs or enhances the antigenicity or immunogenicity of Ag(s) and IM(s). Potential adjuvants may be screened for ability to enhance IR(s).

Adjuvants may be selected from any of the classes (1) mineral salts, e.g., aluminium hydroxide and aluminium or calcium phosphate gels; (2) emulsions including: oil emulsions and surfactant based formulations, e.g., microfluidised detergent stabilised oil-in-water emulsion, purified saponin, oil-in-water emulsion, stabilised water-in-oil emulsion; (3) particulate adjuvants, e.g., virosomes (unilamellar liposomal vehicles incorporating influenza haemagglutinin), structured complex of saponins and lipids, polylactide co-glycolide (PLG); (4) microbial derivatives; (5) endogenous human immunomodulators; and/or (6) inert vehicles, such as gold particles; (7) microorganism derived adjuvants; (8) tenso-active compounds; (9) carbohydrates; or combinations thereof. Cytokine(s) can exhibit adjuvant activity and be considered adjuvants. Other CCCs DEH that can be considered adjuvants include, ligands or stimulants of Toll Like Receptors (TLR) 1, 2, 3, 4, 5, 6, 7, 9, 10, or signaling molecules (e.g., NF-Kappa B subunit p65/Rel A, or Type-1 Transactivator T bet).

In AOTI, adjuvants are selected from inert carriers (such as alum, bentonite, latex, and acrylic particles); pluronic block polymers (such as TiterMax® (block copolymer CRL-8941), squalene (a metabolizable oil) and a microparticulate silica stabilizer)); depot forming agent(s) (such as Freunds adjuvant); surface active materials (such as saponin, lysolecithin, retinal, Quil A, liposomes, & pluronic polymer formulations); macrophage stimulators (e.g., bacterial lipopolysaccharide); alternate pathway complement activators (such as insulin, zymosan, endotoxin, & levamisole); and non-ionic surfactants (such as poloxamers, poly(oxyethylene)-poly(oxypropylene) tri-block copolymers).

Adjuvants for DNA nucleic acid vaccines that can be applied to similar AOTI have been disclosed in, for example, Kobiyama, et al Vaccines, 2013, 1(3), 278-292. Adjuvants for RNA NAVs are described in, e.g., the web-based vaccine adjuvant database, Vaxjo; http://www.violinet.org/vaxjo/ and Sayers, et al., J. Biomedicine and Biotechnology, volume 2012 (2012), Article ID 831486. An extensive disclosure of adjuvants that can be adapted to AOTI are provided in, e.g., US20190167774. Adjuvants can include inorganic adjuvants (e.g. inorganic metal salts such as aluminium phosphate or aluminium hydroxide), organic adjuvants (e.g. saponins or squalene), oil-based adjuvants (e.g. Freund's complete adjuvant and Freund's incomplete adjuvant), cytokines, particulate adjuvants (e g immuno-stimulatory complexes (ISCOMS), liposomes, or biodegradable microspheres), virosomes, bacterial adjuvants (e.g. monophosphoryl lipid A, or muramyl peptides), synthetic adjuvants (e.g. non-ionic block copolymers, muramyl peptide analogues, or synthetic lipid A), or synthetic polynucleotides adjuvants (e.g polyarginine or polylysine). Such compositions are known in the art. E.g., ISCOMs are described in Hu K F et al. Adv Drug Deliv Rev. 2001; 51(1-3):149-159. doi:10.1016/s0169-409x(01)00165-x; Morein B et al. Methods. 1999; 19(1):94-102. doi:10.1006/meth.1999.0833; and WO200408494. Additional adjuvants are described in, e.g., Shah R R et al. Methods Mol Biol. 2017; 1494:1-13. doi:10.1007/978-1-4939-6445-1_1. An extensive disclosure of many types of adjuvants that can be adapted to AOTI, such as polymeric adjuvants, cytokines, and the like, is provided in EP1572941. Further possibly suitable adjuvants include, protamine, poly I:C RNA, invariant chain/LAMP-1, GM-CSF and Co-stimulatory molecules like CD40, the RIBI adjuvant system (Ribi Inc.), Block co-polymer (CytRx, Atlanta Ga.), SAF-M (Chiron, Emeryville Calif.), monophosphoryl lipid A, Avridine lipid-amine adjuvant, heat-labile enterotoxin from E. coli (recombinant or otherwise), cholera toxin, IMS 1314, muramyl dipeptide, and the SPT emulsion or MF59 emulsion (SFE "Vaccine Design, The Subunit and Adjuvant Approach" edited by M. Powell and M. Newman, Plenum Press, 1995). Additional adjuvants and aspects of those DEH are described in Hunter et al., The Theory and Practical Application of Adjuvants (Ed. Stewart-Tull, D. E. S.). JohnWiley and Sons, NY, pp 51-94 (1995) and Todd et al., Vaccine 15:564-570 (1997). In aspects, NAM(s)/NAV(s) are immunogenic in TRs, even independent of expression of EP(s) or EPES NAM(s)/NAV(s) are administered with other nucleic acids that exhibit immunogenic properties. E.g., adjuvant(s) can comprise unmethylated CpG-dinucleotides (SFE U.S. Pat. Nos. 6,207,646, 6,406,705 and 6,429,199 and are also DEH. Additional nucleotide adjuvants are described in Wagner et al. (2000) Springer Semin Immunopathol 22(1-2): 147-52, Van Uden et al. (2000) Springer Semin Immunopathol 22(1-2): 1-9, and Pisetsky (1999) Immunol Res 19(1):35-46, as well as U.S. Pat. Nos. 6,194,388, 6,008,200, 6,239,116, and 6,218,371. mRNA NAVs typically possess self-adjuvating properties. mRNAs encoding adjuvants also can enhance IR(s), such as GM-CSF mRNA and CD40 mRNA. Nucleic acids can also be administered in dosage(s) large enough to be immunogenic (SFE WO2012006372, WO2012006369, USS20130149375 & US20130177640). Thus, while in some aspects CEPESCs are described as non-immunogenic in other AOTI such compositions are immunogenic independent of EP expression.

The ability of an adjuvant to increase IR(s) is typically manifested by a significant increase in immune-mediated protection, e.g., an increase in humoral immunity is typically manifested by a significant increase in the titer of antibodies raised to Ag(s), and an increase in T-cell activity is typically manifested in increased cell proliferation, or cellular cytotoxicity, or cytokine secretion. An adjuvant may also alter IR(s), for example, by changing a primarily humoral or Th2 response into a primarily cellular, or Th1 response. In aspects, adjuvant(s) exhibit DOS IR(s) in ICs, such as ITICs. E.g., poly I:C adjuvants can DOS enhance DC proliferation and activation. TLR or NLR ligands can enhance IC-mediated IR(s). ICR(s) associated with dead cells or ligands thereof also can be used as adjuvant(s) (e.g., CD36, integrin, PtdSerR, or CLEC9A) as can other "dead cell markers," or "eat me signals," e.g., phosphatidylserine (PS) or actin filaments. In aspects, adjuvant(s) comprising TLR ligand(s), such as LPS, CpG, poly I:C DOS inhibit cross-presentation, DOS inhibit tolerance, or DOS otherwise enhance IR(s). In aspects, adjuvant(s) comprise aptamers or siRNA molecules (e.g., siRNAs targeting PD-L1). Additional adjuvant(s) include other ligands for DC ICR(s), such as beta glucan, lipoglycans and other lipocarbohydrates, and carbohydrate recognized by DCRs.

II. Methods of Use

As DEH, AOTI include methods of using CEPESCs and other compositions DEH to induce IR(s) or CE(s) and, in AOTI, prevent or treat diseases associated with DCAs in TR(s), e.g., pathogen infections or cancers.

Methods of the invention can be applied to any type of TR, including human patients and non-human subjects, such as swine, cows, dogs, cats, chickens, horses, and the like (e.g., companion animals and livestock animals).

In aspects, CEPESCs are used as therapeutic or prophylactic agents. In aspects, CEPESCs are delivered one or more times to TR(s). In aspects, CEPESC(s) are used to stimulate cells and the cells are infused into TR(s).

A. Delivery Characteristics (Dosing Strategies, Target Tissues, Etc.)

CEPESCs can be delivered/administered to TRs by any suitable technique(s), into any suitable tissue(s), any suitable number of time(s), and in any suitable amount(s). In aspects, CEPESCs are delivered in a single dose, in several divided dosages, or staggered dosages. In aspects, CEPESCs are administered daily or sequentially. In aspects, CEPESCs are continuously infused. In aspects, CEPESCs are delivered via bolus injection. CEPESC dosages may be proportionally increased or decreased based on clinical conditions or CEs. Different CEPESCs, CCCs, dosage amounts, number of dosages, etc., can be applied also based on CEs, AEs (e.g., cytokine syndrome effects), and the like.

In aspects, CEPESCs are delivered to TRs by intramuscular, subcutaneous, intradermal, intravenous, inhalation, insufflation, oral, nasal, rectal, parenteral, sublingual, paracanceral, transdermal, transmucosal (e.g., (trans)buccal, (intra)nasal, and (trans)rectal), intravesical, intrapulmonary, intraventricular, intraduodenal, intra-tumoral, intragastrical, intrathecal, intra-arterial, or intrabronchial administration. In aspects, CEPESCs are delivered by mucosal administration. In aspects, CEPESCs are delivered by injection (e.g., i.m. or s.c. injection). In aspects, CEPESCs are delivered intradermally, e.g., by biolostic/gene gun delivery methods (SFE Haynes et al, J Biotechnology 44: 37-42 (1996) & U.S. Pat. Nos. 5,846,796; 6,010,478; 5,865,796; & 5,584,807).

In aspects, delivery of CEPESCs into target cell(s) is facilitated by application of electroporation methods (SFE Chicaybam et al., (2013) PLoS ONE 8(3): e60298; Van Tedeloo et al. (2000) Gene Therapy 7(16): 1431-1437); and Lambricht L, et al Expert Opin Drug Deliv. 2016; 13(5):769 and 2016; 13(2):295-310). Other methods applicable to delivery of CEPESCs comprise protoplast fusion, cationic liposome-mediated transfection; tungsten particle-facilitated microparticle bombardment (Johnston, Nature, 346: 776-777 (1990)); and strontium phosphate DNA co-precipitation (Brash et al., Mol. Cell Biol., 7: 2031-2034 (1987)).

In certain embodiments, the compositions are administered to muscle, either skeletal muscle or cardiac muscle, or to lung tissue. Such methods are exemplified in, e.g., Wheeler, C. J., et al., Proc. Natl. Acad. Sci. USA 93:11454-11459 (1996).

According to the disclosed methods, compositions of the present invention can be administered by intramuscular (i.m.), intradermal (i.d.), subcutaneous (s.c.), or intrapulmonary routes. Other suitable routes of administration include, but are not limited to intratracheal, transdermal, intraocular, intranasal, inhalation, intracavity, intravenous (i.v.), intraductal (e.g., into the pancreas) and intraparenchymal (i.e., into any tissue) administration. In aspects, CEPESCs are delivered via transdermal (e.g., percutaneous) and transmucosal administration (i.e., into or through skin or mucosal tissue). In aspects, CEPESCs are delivered by two or more methods (e.g., by i.m. or s.c. and mucosal delivery).

Delivery of NAMs to interstitial spaces of tissues of an individual is described in, e.g., Felgner et al., U.S. Pat. Nos. 5,580,859 and 5,703,055 and other references CEH. CEPESCs can be administered by methods well known in the art as described in Donnelly et al. (Ann. Rev. Immunol. 15:617-648 (1997)); Felgner et al. (U.S. Pat. No. 5,580,859, issued Dec. 3, 1996); Felgner (U.S. Pat. No. 5,703,055, issued Dec. 30, 1997); and Carson et al. (U.S. Pat. No. 5,679,647, issued Oct. 21, 1997). CEPESCs can be complexed to particles or beads (e.g., PDAs) that can be administered to an individual, for example, using a vaccine gun. CEPESCs can comprise formulation elements as DEH.

Administration means for CEPESCs can include needle injection, catheter infusion, biolistic injectors, particle accelerators (e.g., "gene guns" or pneumatic "needleless" injectors) Med-E-Jet (Vahlsing, H., et al., J. Immunol. Methods 171:11-22 (1994)), Pigjet (Schrijver, R., et al., Vaccine 15: 1908-1916 (1997)), Biojector (Davis, H., et al., Vaccine 12: 1503-1509 (1994); Gramzinski, R., et al., Mol. Med. 4: 109-118 (1998)), AdvantaJet (Linmayer, I., et al., Diabetes Care 9:294-297 (1986)), Medi-jector (Martins, J., and Roedl, E. J. Occup. Med. 21:821-824 (1979)), gelfoam sponge depots, other commercially available depot materials (e.g., hydrogels), osmotic pumps (e.g., Alza minipumps), or use of polynucleotide coated suture (Qin, Y., et al., Life Sciences 65: 2193-2203 (1999)). Certain modes of administration are intramuscular needle-based injection and pulmonary application via catheter infusion. Energy-assisted plasmid delivery (EAPD) methods may also be employed to administer the compositions of the invention. One such method involves the application of brief electrical pulses to injected tissues, a procedure commonly known as electroporation. See generally Mir, L. M. et al., Proc. Natl. Acad. Sci. USA 96:4262-7 (1999); Hartikka, J. et al., Mol. Ther. 4:407-15 (2001); Mathiesen, I., Gene Ther. 6:508-14 (1999); Rizzuto G. et al, Hum. Gen. Ther. 11:1891-900 (2000); and U.S. Pat. Nos. 7,664,545; 6,302,874; 5,676,646; 6,241,701; 6,233,482; 6,208,893; 6,192,270; & 5,702,359.

In aspects, CEPESCs can be delivered by transdermal administration (e.g., aided by iontophoresis, electroporation, or use of a PDA, such as a tat-conjugated dendrimer) (SFE Bahadoran A et al. J Pharm Pharm Sci. 2016; 19(3):325-338. doi:10.18433/J3G31Q; Cashman K A et al. Hum Vaccin Immunother. 2017; 13(12):2902-2911) (iontophoresis and electroporation methods are known, SFE Banga A K et al. Int J Pharm. 1999; 179(1):1-19 and references CEH in connection with such methods). Epidermal administration of the vaccine can also be employed. Epidermal administration can involve mechanically or chemically irritating the outermost layer of epidermis to stimulate an immune response to the irritant (Carson et al., U.S. Pat. No. 5,679,647).

In aspects, CEPESCs are formulated for administration to mucosa, e.g., via the nasal passages. Formulations suitable for nasal administration, wherein a solid carrier, such as a PDA is used, can include a coarse powder having a particle size, for example, in the range of about 10 to about 500 microns which is administered in the manner in which snuff is taken, i.e., by rapid inhalation through the nasal passage from a container of the powder held close up to the nose. The formulation can be a nasal spray, nasal drops, or by aerosol administration by nebulizer. The formulation can include aqueous or oily solutions of the vaccine. In aspects, RFU CEPESCs take the form of a liquid preparation, such as a suspension, solution, syrup or elixir (e.g., for parenteral, intradermal, s.c., i.m., or intravenous administration (e.g., injectable administration), e.g., as a sterile suspension or emulsion.

In aspects, methods comprise administering a CEPESC to a TR one single time. In aspects, a CEPESC is administered to a TR at two different times or 2 different CEPESCs are administered on different times. In aspects, CEPESC(s) are administered three times (e.g., a single CEPESC is administered at 3 different times, 3 different CEPESCs are administered at different times, or methods comprise some mixture of repeat administration and administration of different CEPESC(s)). In aspects, CEPESCs are administered four times to TR(s). In aspects, CEPESC(s) are administered more than four times to TR(s). In aspects in which multiple administrations of CEPESC(s) are performed, such CEPESC(s) can be administered at regular intervals, e.g., daily, weekly, every two weeks, every three weeks, every month, every 2 months, every quarter, semi-annually, annually, etc. Each possibility represents a separate embodiment of the methods disclosed herein.

To exemplify, a dose of CEPESCs can be delivered to TR(s) every 1-2 weeks, every 2-3 weeks, every 3-4 weeks, every 4-5 weeks, every 6-7 weeks, every 7-8 weeks, every 9-10 weeks, or every 1-24, 1-18, 1-12, 1-9, 1-6, 1-4, 3-4, 4-5, 6-7, 7-8, 9-10, 1-3, 2-3, or 1-2 months in order to achieve the intended elicitation of IR(s)/CE(s).

In aspects, repeat administrations (booster doses) of CEPESCs are applied to TR(s) immediately following the first course of treatment or after an interval of days, weeks or months to induce intended IR(s)/CE(s).

In one embodiment, a subject is administered a booster dose every 1-2 weeks, every 2-3 weeks, every 3-4 weeks, every 4-5 weeks, every 6-7 weeks, every 7-8 weeks, or every 9-10 weeks in order to achieve the intended anti-tumor response. In one embodiment, a subject is administered a booster dose every 1-2 months, every 2-3 months, every 3-4 months, every 4-5 months, every 6-7 months, every 7-8 months, or every 9-10 months in order to achieve the intended elicitation of an immune response targeted at the subject's disease or condition. E.g., CEPESCs can be administered every 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or 31 days, or 1-10, 2-10, 1-5, 2-4, 1-4, 1-3, or 2-3 times over a period of 2 years, 1.5 years, 12 months, 9 months, 6 months, or 3 months (such administrations separated by 0.5-24 months, e.g., 1-12 months, 1-6 months, or different periods falling within any such range). The number of total applications of CEPESC(s) in a method, such as a disease treatment method, can be, e.g., 1, 2, 3, 4, 5, 6, 7, 8, 9, or 10 times.

In aspects, delivery of multiple CEPESCs; multiple doses of CEPESCs, ≥2 CEPESC(s)+CCC(s); or application of AAC(s) and delivery of CESPESC(s) comprises step(s) of monitoring efficacy (e.g., against standard(s)), monitoring AE(s) (e.g., cytokine syndrome, immunogenic reactions, and the like), or both, and adjusting the timing of delivery, amount of delivery, frequency of delivery, dosage amount(s), or selecting second or more subsequent CCC/CEPESC to deliver or AAC to apply. E.g., In AOTI, methods comprise performing a method that DOS stimulates DCs, NKCs, or both, optionally with other ITICs or ICs in a population of TRs (e.g., as determined by clinical study or studies) in a TR and thereafter delivering CEPESC(s) to the TR. In one case, a composition comprising an effective amount of an EAT-2 PPT or EAT-2-ES NAM is delivered to a TR and after either a period of time that normally is sufficient for IC stimulation or after the detection of stimulation in the TR CEPESC(s) are administered (e.g., a CEPESC comprising gDAgFP(s)).

CEPESCs can be delivered in any suitable dosage(s) delivered any suitable number of time(s). In aspects, each dosage of CEPESC or NAM(s) in CEPESC ranges from ~0.001 to 30 mg/kg TR body wt, about 0.01 to 25 mg/kg body weight, about 0.1 to 20 mg/kg body weight, or from about 1 to 10 mg/kg, 2 to 9 mg/kg, 3 to 8 mg/kg, 4 to 7 mg/kg, or 5 to 6 mg/kg body weight.

In multiple CEPESC methods or combination methods, CEPESCs or CEPESC(s) & CCC(s)/AAC(s) can be administered simultaneously, for example in a combined unit dose or separately in a specified time interval, e.g., in an interval of minutes, hours, days or weeks. Such agents may be administered in any order, or as 1+ preparations that includes 2+ agents. In aspects, at least one administration of one of the agents, e.g., a "first agent," may be made within minutes, one, two, three, or four hours, or even within one or two days of the other agent, e.g., a "second agent." In some embodiments, combinations can achieve synergistic results, e.g., greater than additive results, e.g., at least 25, 50, 75, 100, 200, 300, 400, or 500% greater than additive results.

In aspects, CEPESC(s) are delivered as part of a "prime boost" dosing/treatment regimen. An example of a "prime boost" regimen may be found in Yang, Z. et al., J. Virol. 77:799-803 (2002). The difference in time between the "prime" administration of a CEPESC or application/delivery of an AAC (e.g., a different immunogenic composition, such as those DEH), and the "boost" repeat/initial dosage of the CEPESC, a different CEPESC, or repeat or different application/dose of AAC can be, e.g., 1 week, 2 weeks, 4 weeks, 6 weeks or 8 weeks. More particularly, it is 4 weeks or 8 weeks.

In aspects, CEPESCs are delivered between 1 and 7 times, preferably between 1 and 4 times, at intervals between about 1 day and about 18 months. In aspects, multiple different CEPESCs or CEPESCs and AACs are administered/applied to TR(s). E.g., CEPESCs or CEPESC(s) and AAC(s) can be administered/applied 2-12, 2-10, 2-8, 2-6, 2-5, or 2-3 times to TR(s). Typically, CEPESC(s) are applied 2, 3, 4, or 5 times to TR(s). In aspects, AAC(s) and CEPESC(s) are administered/applied simultaneously, or substantially simultaneously (e.g., within the same 30 minutes, 20 minutes, 15 minutes, or 5 minutes). In aspects, AAC(s) and CEPESCs are administered/applied at different times, e.g., within 1-8 hours, 1-2 hours, 1-3 hours, or 1-4 hours, or are separated by 1-12 days, e.g., 1-8 days, 1-7 days, 1-5 days, 1-4 days, 1-3 days, or 1-2 days, and in aspects such administrations/applications or separated by 1-12 weeks, 1-10 weeks, 2-12 weeks, 2-8 weeks, 1-8 weeks, 1-6 weeks, 2-6 weeks, 3-12 weeks, 3-9 weeks, 4-12 weeks, 4-8 weeks, 1-4 weeks, or 2-4 weeks, or 2-18 months, 2-12 months, 2-8 months, 2-6 months, or 2-4 months, such as 3-15 months, 3-9 months, 3-6 months, 3-12 months, 4-12 months, 4-8 months, or 4-6 months.

B. Target Recipients (TR(s)—Subjects)

Methods of the invention can be applied to any suitable individual target recipient (TR) (also sometimes referred to as "subjects") or population of TR(s). TR(s) can be any vertebrate that is infectable by a-HVs. In aspects, TR(s) are mammals. In aspects, TR(s) are non-mammalian vertebrates, e.g., birds. In aspects, TR(s) are humans (sometimes also referred to as "patients"). In aspects, TR(s) are non-human animals (NHAs). In aspects, NHAs are livestock/farm animals (e.g., cows, cows, sheep, chickens, goats, geese, bison, ducks, turkeys, and the like), sport animals, companion animals/pets (such as cats, dogs and horses), wild animals (e.g., in methods in which efforts are made to prevent transmission of viruses or other pathogen(s) to human(s) or other animals to preserve populations), zoological animals (e.g., primates), and animals used in laboratory studies (e.g., rodents such as mice, rats, and the like, rabbits, etc.). In aspects, TR(s) are ungulates. In aspects, TR(s) are even-toed ungulates (order Artiodactyl) (e.g., cows, sheep, goats, or pigs).

1. Non-HVEM-Expressing TRs

In aspects, TR(s) are NHA(s) that do not express HVEM or a known HVEM analog. In aspects, such TR(s) include horses or pigs/swine (for which HVEM homologs have not yet been identified and may not be present) or cows (for which no HVEM homolog has been identified and which are expected to not possess a HVEM homolog). In aspects, OSMGAOA gDP(s) delivered to such TR(s) lack any HVEMBD or comprise a HVEMBD with significantly reduced affinity for known HVEM gDR(s). In aspects, CEPs expressed in such methods comprise 1+ NGDPCIs, such as a PD-L1 trap or an anti-PD-L1 Ab. In aspects, SMGAOA gDP(s) in CEPs delivered to such NHA(s) bind N1 or N2.

In aspects, TR(s) are NHAs known to express HVEM (e.g., dogs, mice, African Green Monkey, and guinea pigs).

In aspects, OSMGAOA gDP(s) in CEPs expressed in such TR(s) comprise HVEMBD(s). In aspects, SMGAOA of such gDP(s) exhibit CI properties in such TR(s). In aspects, SMGAOA of such gDP(s) exhibit enhanced HVEM binding WRT to WT gDP(s), e.g., the WT gDP of the virus that infects the species of the TR.

2. Non-Immunologically Suppressed TRs

In aspects, TRs are not immunologically suppressed TRs (ISTRs). In aspects, TRs are not ISTRs that undergoing a condition associated with DOS checkpoint inhibition to DCAs. For example, TRs that have well-developed cancers often have significant checkpoint inhibition. In such TRs although endogenous CAg(s) are present, ICs are either not active or not capable of inducing effective CE(s) due to the checkpoint inhibition. In such TR(s), particularly in HVEM-expressing TR(s) delivery of gDP(s) can induce IR(s)/CE(s) by, in significant part, mostly, or generally through relieving BTLA/HVEM checkpoint inhibition. Methods involving such checkpoint inhibition-blocking gDP(s) are an aspect of the invention. However, delivering CEPESCs to TR(s) that do not exhibit such a form of immunosuppression is another AOTI, as the ability to induce effective IR(s)/CE(s) in TR(s) that do not contain such pre-built up blocked IR(s) is a meaningfully different physiological context in which to induce IR(s)/CE(s) and to treat or prevent disease.

3. "Leaky Vaccine" Treated TRs and Leaky Vaccine Only Option TRs

In aspects, CEPESC(s) are delivered to TR(s) that have been treated with a "leaky vaccine" or TR(s) for which the standard of care only affords a leaky vaccine option (e.g., pigs WRT to PCV or PRRSV or humans or other animals with respect to influenza). AOTI relating to leaky vaccines are DEH. In aspects, the TR(s) are NHA(s) and the CEPESC is administered to a defined population, such as a herd associated with an area, ranch, farm, or other facility/location. In aspects, delivery of CEPESC(s) DOS reduces leaky vaccine effects, such as spread of the condition through the population, through neighboring populations, spread to new members of the population, and the like. In aspects, CEPESCs are delivered to TR(s) for which the available standard of care produces leaky vaccine effects. The inventors have discovered that the CEPESCs and methods of this disclosure can unexpectedly significantly reduce or eliminate leaky vaccine effects and provide a meaningfully different alternative in prevention or treatment of DCA-associated diseases, e.g., pathogen-associated diseases, over currently marketed "leaky vaccine" vaccine products and therapeutics. In aspects, such TR(s) are horses and the method is applied to horses having been treated with an EHV-1 or EHV-4 leaky vaccine or is applied to horses to protect the horses from developing EHV-1 or EHV-4, which currently would be "leaky vaccine" DCAs. The leaky vaccine status of EHVs is described in, e.g., Allen G P et al. "Equid herpesvirus-1 (EHV-1) and -4 (EHV-4) infections." In: Coetzer, J A W and Tustin, R C (Eds.), INFECTIOUS DISEASES OF LIVESTOCK. 2nd Edn. Oxford Press: Cape Town; 2004. pp. 829-859.

C. Outcomes—IRs, CEs, Prevention, & Treatment

Delivering EA(s) of CEPESC(s) to TR(s) DOS induces IR(s), typically causing DOS CE(s), and often resulting in DOS evidence of treatment or prevention of DCA-associated disease(s)/condition(s). Aspects of IR(s), CE(s), and disease treatment/prevention are briefly discussed here. Such AOTI/IR(s) are also DEH & in art CEH. CEPESC(s) can induce any suitable number and type of IR(s). Specific IR(s) are described below and elsewhere here.

IR(s) include, e.g., DOS T and/or B cell responses, i.e., cellular and/or humoral immune responses, e.g., cytotoxic T cell responses, innate immune response, and innate trained IRs (ITIRs) (e.g., DC or NKC response(s)). Humoral immunity involves plasma cells (activated B cells) and memory B cells, production of Ag-specific Abs by such B cells, & typically resulting neutralization or opsonization of DCAs. Cellular immunity involves the production of effector TC, mTCs, & NKCs, including CD4+T & CD8+ TCs, responsible for direct (cell-to-cell) or indirect (cytokine-mediated) destruction of infected cells (Wood P R et al. Veterinary Immunology &Immunopathology 54:33-44 (1996) & Allen J E et al. Immunology Today 18:387-392 (1997)).

IR(s) include DOS "adaptive" IR(s), "innate" IR(s), and "innate trained" IR(s). Such aspects of the immune system are known. Briefly "adaptative immunity" means IR(s) carried out by hematopoietic T cells and B cells derived from the lymphoid lineage. APCs, particularly DCs, recognize DCA(s), process Ag(s), and present Ag(s) via MHC to naive T cells (Th0), Ag-specific TCs are activated leading to expansion into effector TCs (Th1, Th2, and Th17 cells), which prime or implement humoral immunity, pro-inflammatory cytokine secretion, and activation of other ICs. Long half-life T cells become mTCs. "Innate immunity" comprises hematopoietic cells including mast cells, neutrophils, and eosinophils derived from myeloid lineage, and involves non-specific IR(s), such as non-specific DCA-associated cell phagocytosis (e.g., in response to immunostimulatory signals activated neutrophils express Fc and complement receptors allowing increased phagocytosis and activated macrophages secrete proinflammatory cytokines/chemokines such as MIP-1B). "Innate trained immunity" (aka "trained immunity" or "innate immune memory") refers to the ability of cells typically of hematopoietic lineage e.g., macrophages, monocytes, DCs, & NKCs, to exhibit DOS enhanced IR(s) in reencountering DCAs, resulting in enhanced inflammatory responses and cytotoxic response (aspects adaptable/applicable to AOTI in e.g., Hajishengallis G et al. Adv Exp Med Biol. 2019; 1197:11-26; Lerias J R et al. Front Microbiol. 2020; 10:2924. Published 2020 Jan. 10; Rusek P et al. Int J Mol Sci. 2018; 19(2):456. Published 2018 Feb. 3; and van der Meer J W et al. Mol Immunol. 2015; 68(1):40-44). The characterization of ITICs is evolving and not consistent (Guilliams M et al. Nat Rev Immunol. 2014; 14(8):571-578), and the principles here should be interpreted to encompass changes in nomenclature with respect to such cells. In aspects, delivering EA(s) of CEPESC(s) induces "specific" IRs, which include both DOS adaptive IR(s) & ITIR(s). Methods OTI induce/stimulate primary or secondary immune responses. In AOTI, IR(s) comprise DOS memory IR(s). In aspects, memory IR(s) resulting from EA(s) of CEPESC(s) are significantly greater than those obtained with comparable DNA vaccines, PPT vaccines, or even constructs of the Wistar Art but lacking the features of constructs OTI (e.g., i.a., inclusion of an ITICITM, such as ITICSTAP(s) (e.g., EAT-2 PPT(s) or EAT-2 & SAP PPT(s)), inclusion of PTPS(s), and use of EEI(s) and CaPNP(s). Such AOTI are DFEH.

In aspects, delivery of EA(s) of CEPESCs can result in, e.g., an at least about 2-fold (200%) increase in antigen presentation, such as an at least about 5-fold increase in antigen presentation, an at least about 10-fold increase in antigen presentation, an at least about 20-fold increase in antigen presentation, and at least about 30-fold increase in antigen presentation, an at least about 50-fold increase in antigen presentation, an at least about 100-fold increase in antigen presentation, or more (such as an about 2-about 100, about 10-about 100, about 20-about 100, about 2-80, about 5-80, about 10-80, about 2-50, or about 5-50 increase in antigen presentation) (measuring antigen presentation is exemplified in Mahnke K, et al. J Cell Biol. 2000; 151(3): 673-684).

In aspects, CEPESCs induce DOS IR(S) in bystander ICs. In aspects, such IR(s) comprise DOS IR(s) in bystander DCs. In aspects, such IR(s) comprise DOS IR(s) in bystander TCs. Aspects of bystander immunity and ICs are described in, e.g., Whiteside S K et al. Trends Immunol. 2018; 39(12):1021-1035 and Macdonald D C, et al. J Immunol. 2014; 193(10):5056-5064.

IRs can comprise IC phenotype skewing, expansion, maintenance, differentiation, dedifferentiation, survival, proliferation, cytotoxicity, persistence, and/or cell recall/memory, thereby improving the therapeutic potential of the immune cells. In a T cell population, for example, phenotype skewing towards naive, stem cell memory, or central memory T cells results in an increased number or relative ratio of the naive, stem cell memory, or central memory T cells subpopulation and/or decreased number or relative ratio effector memory or effector T cell subpopulation through modulating maintenance, expansion, differentiation, and/or de-differentiation thereof, are indicative of better quality of the T cells for improved in vivo adoptive therapeutic potential. In one embodiment, the number or proportion of naive TCs. IRs can comprise DOS increases in IC proliferation, cytotoxicity, or persistence. In aspects, IR(s) comprise an increased number or relative ratio of naive T cells (Tn), stem cell memory T cells (Tscm), and/or central memory T cells (Tcm), and/or improved cell proliferation, cytotoxicity, cell recall, and/or persistence in comparison to the T cells without the same treatment. In some embodiments, the number of Tn, Tscm, and/or Tcm is increased by at least 10%, 20%, 30%, 40%, 50%, 60%, 70%, 80%, 90%, or more, or increased by at least 2, 3, 4, 5, 10, 15, or 20 fold, or more, compared to the number of Tn, Tscm, and/or Tcm in the cell population without the same treatment. In aspects, the population or subpopulation of NK cells contacted with one or more of said modulating agents comprises an increased number or relative ratio of adaptive (or memory) NK cells, and/or improved cell proliferation, cytotoxicity, cell recall, and/or persistence in comparison to the NK cells without the same treatment. In aspects, the number of adaptive NK cells is increased by at least 10%, 20%, 30%, 40%, 50%, 60%, 70%, 80%, 90%, or more, or increased by at least 2, 3, 4, 5, 10, 15, or 20 fold, or more, compared to the number of adaptive NK cells in the cell population without the same treatment. In aspects, EA(s) of CEPESC(s) results in IR(s) comprising DOS increased number or activity of activated TCs (CD134+, CD137+, and FOXP3+); increased number or activity of activated NKCs (e.g., NKp46+ NKCs), increased eosinophil counts, improved Teff to Treg ratio, increased active phenotype monocytes (CD16+ and CD68+), or increased total monocyte counts.

1. IC-Specific IRs

As reflected above, CEPESC(s) can induce IR(s) in different ICs and groups of ICs. ICs include cells of hematopoietic origin; lymphocytes, such as B cells and T cells; natural killer cells; and myeloid cells, such as monocytes, macrophages, eosinophils, mast cells, basophils, and granulocytes. In aspects, IR(s) are induced in cells that are not classified as ICs, but which are capable of IR(s), such as fibroblasts. Induction of IR(s) in such non-IC cells are DEH. Hematopoietic progenitor cells typically can be categorized as either myeloid progenitors or lymphoid progenitors. The myeloid progenitor cells are able to give rise to myeloid lineage cells including platelets, eosinophils, basophils, neutrophils, monocytes, and erythrocytes. Lymphoid progenitor cells are capable of differentiating into T-cells and B-cells, i.e., adaptive immunity cells. In aspects, CEPESCs induce IR(s) in such cells. In aspects, CEPESCs also induce IR(s) directed against cells of such lineage that are impacted by DCA(s) (e.g., induce IR(s) mediated by NKCs activated by EAT-2, gDP(s), and Ag(s) against hematopoietic lineage DCA-associated cells).

IR(s) can involve multiple facets of any such categories of IRs and IRs that involve "crosstalk" between such different aspects of the overall IR. E.g., subsets of αβ T cells restricted by the non-polymorphic MHC class I-like molecules CD1d and MHC-related protein 1 (MR1) (known as invariant NKT cells and mucosa-associated invariant T cells, respectively), as well as T cells expressing γδ TCRs5 (non-conventional, innate-like or transitional T cells) recognize conserved non-peptide antigens that are upregulated by stressed cells, the expression modalities and distribution of which resemble those of pathogen-associated molecular patterns (PAMPs) or danger-associated molecular patterns (DAMPs) recognized by PRRs. These cells acquire a pre-activated phenotype associated with the upregulation of memory markers early in their development. This pre-activated status allows rapid induction of effector functions following the detection of tissue stress. Such cells are implicitly included in AOTI relating to innate trained immunity cells, but also can represent an independent AOTI. E.g., in aspects CEPs comprise agonists of such cells, Ag(s), gDP(s), and optionally cytokine(s), such as IL-2 PPTs. CEPESCs can induce multiple IR pathways (aspects of which are described in, e.g., WO2012006377 & US20130177639;).

CEPESCs typically exhibit enhanced IR(s) as compared to administration of Ag(s) as PPTs, administration of DNA vaccines comprising such Ag(s), or even over corresponding constructs designed according to the principles of the Wistar Art. E.g., IR(s) arising from EA(s) of CEPESCs can be increased by about 20-500%, e.g., about 33-300%, e.g., about 50-250%, or about 75% to about 200% (e.g., about 20-200%). E.g., IR(s) can be increased by at least about 60%, 70%, 85%, 90%, 95%, 97%, 110%, 120%, 125%, or 130%. In aspects, IR(s) increased by at least about 1.5-fold, 2.0-fold, 2.5-fold, 3.0-fold, 4.0-fold, 5.0-fold, 7.0-fold, 8.0-fold, or at least about 10.0-fold.

In aspects, CEPESCs induce DOS IR(s) in adaptive ICs, innate ICs, or innate trained ICs. In aspects, CEPESCs induce humoral IR(s), cellular IR(s) (e.g., cytotoxic IR(s) or cytokine-expression IR(s)), or both. In aspects, CEPESCs induce IR(s) in APCs, e.g., DCs. In aspects CEPESCs induce IR(s) in T, NK and NKT cells. In aspects, CEPESCs induce IRs in BCs, TCs, and DCs. In aspects, CEPESCs induce DOS IRs in, i.a., BCs, TCs, DCs, and NKCs. In aspects, IR(s) in TCs include both CD4 TCs and CD8 TCs. In aspects, such IR(s) comprise an increase in the number of such cell(s) in TR(s) or an increase in the relative ratio of such cells (e.g., an increase in the number or ration of stem cell memory TCs or central memory TCs).

i. Adaptive IC IRs

In aspects, IR(s) comprise adaptive IC IR(s). In aspects, such IR(s) comprise DOS TC IR(s), BC IRI(s), or both. As DEH, BC IR(s) comprise DOS increased Ab production and other BC IR(s) such as opsonization. E.g., in aspects, CEPESCs result in an increase in TC frequency of at least 2×, at least 2.5×, at least 3×, at least 3.5×, or more over baseline, a suitable period after initial administration or after 2 or 3 administrations of CEPESCs (e.g., 2-16, 2-12, or 2-10 weeks after initial or boosting administration).

CEPESCs can induce TC IRs in several type of T cells at various developmental stages, including but not limited to, CD4+/CD8+ double positive T cells, CD4+ helper T cells (e.g., Th1 and Th2 cells), CD8+ T cells (e.g., cytotoxic T cells), stem cell memory T cells (Tscm), peripheral blood mononuclear cells (PBMCs), peripheral blood leukocyte (PBL)-associated TCs, tumor infiltrating lymphocytes (TIL) TCs, memory T cells, naive T cells, regulatory T cells, gamma delta T cells (γδ T cells), as well as Th3, Th17, Th9, or Tfh cells. Additional types of memory T cells include cells such as central memory T cells (Tcm cells), effector memory T cells (Tem cells and TEMRA cells). In aspects, TCs are isolated/modified TCs, e.g., T cells modified to express a T cell receptor (TCR) or a chimeric antigen receptor (CAR).

In aspects, CEPESCs DOS enhance the ratio of T effector cells (e.g., T effector cells specific to Ag(s) in CEPs) to regulatory T cells (Tregs), e.g., in an organ of a TR (e.g., the spleen), in tumor(s), or in the TR overall.

In aspects, CEPESCs DOS enhance CD8 TC IR(s). In aspects, CD8 TC IR(s) comprise DOS Th1-cytokine expression, such as DOS IFN-γ. In aspects IR(s) comprise DOS CD8 TC production of granzymes or perforins. In aspects, IR(s) comprise DOS TC killing of DCA-associated cells. In aspects, CD8 TC IR(s) comprise DOS TC expression of TNF-α, and IL-2. In aspects, IR(s) comprise detectable increase in CD8 TCs or specific CD TC(s) (e.g., CD8 TCs specific for Ag(s) in CEPs). In aspects, IR(s) comprise an increased proportion of CD8 TCs among TCs or as compared to DCA-associated cells in a TR. In aspects, the number of Ag-specific CD8 TCs, the amount of Th1 cytokines expressed in TRs, or both, in response to EA(s) of CEPESC(s) are enhanced by 1.5×, 2×, 2.5×, 2.75×, 3×, 3.25×, 3.5×, 4×, 4.5×, or 5×. In aspects, IR(s) comprise other DOS enhancements of CD8 TC IRs, which are known (SFE Cox M A, Zajac A J. Shaping successful and unsuccessful CD8 T cell responses following infection. *J Biomed Biotechnol.* 2010; 2010:159152).

In aspects, delivery of EA(s) of CEPESC(s) induces DOS CD4 TC IR(s). In aspects, CD4 TC IR(s) comprise Th1 or Th2 CD4 IR(s) (e.g., expression of IFN-γ and expression of IL-4, IL-5, and IL-13, respectively). In aspects, CD4 TC(s) comprise DOS upregulation of ligands, such as CD80 and CD86, on DCs. In aspects, CEPESCs comprise known non-DCA-associated (universal) CD4 epitope Ag(s), such as PADRE epitopes or natural tetanus sequences. In aspects, universal or other CD4 epitopes are fused to CD8+T epitopes. In aspects, such CEPs also include other known or predicted Ag-specific CD4 TCEs. Such AOTI are DEH. In aspects, CEPs further comprise CD40 ligand PPTs, which can enhance TC IR(s) and DC IR(s).

In aspects, CEPESC(s) induce DOS CD4 and CD8 TCs. In aspects, the CD4 and CD8 TC IR(s) are balanced in a manner that DOS enhances CD8 mTCs in TRs as compared to in the absence of CD4 IRs or significantly lower CD4 IRs. In aspects, IR(s) comprise a DOS increase in the number of CD8 T cells phenotypically evidencing they were primed and maintained in the presence of CD4 TCs, e.g., by expression of markers $CD62L^{lo/hi}$, $CD122^{hi}$, and $CD127^{hi}$ (versus $CD62L^{lo}$, $CD122^{lo}$, and $CD127^{lo}$. Thus, an enhanced ratio of the former to the latter is an AOTI, as is DOS enhanced CD8 TC cytokine expression, or both. In aspects, CD4 TC IR(s) comprise DOS expression of IL-2 and IL-21, upregulation of B lymphocyte-induced maturation protein 1. In aspects, CD4 TC IR(s) comprise DOS increases in mTC populations.

ii. ITIC IR(s)

In aspects, delivering EA(s) of CEPESC(s) induce ITIC IR(s). In aspects, ITIC IR(s) include DOS increased population, activation, or both of NKC(s) (e.g., granzyme B+ NK cells), monocytes (e.g., HLA-DR+ monocytes), macrophages, NKCs, DCs (e.g., CD8α+ DCs), NKT cells (e.g., Type I NKT cells), or combinations. In aspects, such IR(s) comprise increases in concentration(s) of such cells in tissues/organs of a TR, increased numbers of SMGAOA of such cells, increased activation of OSMGAOA of such cells, or combinations. In aspects, ITIC IR(s) comprise DOS enhanced production of IL-6, TNF-α, IL-1p, IL-18, IL-12, L-1b GM-CSF, IL-23, or combinations. In aspects, such IR(s) comprise enhanced IFNg production by NKCs, enhanced production of IL-12 by DCs, or both. In aspects, IR(s) comprise DOS enhanced production of IL-2, IFNg, TNF-α, IL-4, or combinations. In aspects, DC(s) primarily, generally, or only promote Th1 CD4 TC IR(s). In aspects primarily, generally, or only promote Th2 CD4 TC IR(s). In aspects, CEPESCs DOS induce DCs to promote both Th1 and Th2 TC IR(s). In aspects, CEPESCs comprise IL-12 PPTs and DOS induce Th1-associated DC IR(s). In aspects, IR(s) comprise DOS polarization of ITIC(s) or other IC(s). In aspects, IR(s) comprise repolarization of macrophages. In aspects, IR(s) comprise DOS increases in population, activity, or both of NKCs that are CD3- and CD56+, expressing and have at least one of CD57+, NKG2C and CD57, and optionally, CD 16, but exhibit DOS low expression (or no detectable expression of) PLZF, I=SYK, FceRy, FcsRy, TIGIT, IPD1, CD7, or CD161, and further may exhibit DOS high levels of LILRB1, CD45RO, or CD45RA. In aspects, IR(s) comprise DOS enhanced proliferation or activation of NKCs exhibit DOS enhanced NKG2C or CD57, or CD57, CD16, NKG2C, CD57, NKG2D, NCR ligands, NKp30, NKp40, NKp46, NKG2A, or DNAM-1. In aspects, IR(s) comprise DOS NKC expression of perforin or granzyme. Other various aspects of ITIC IR(s) associated with CEPESC delivery are DEH.

2. Non-IC IR(s)

In aspects, CEPESCs induce DOS IR(s) in non-immune cells. In aspects, such non-IC IR(s) are in addition to DOS IR(s) in IC(s). Examples of non-IC(s) that can exhibit IR(s) include mesenchymal stem cells which can comprise Toll-Like Receptors (TLRs) and exhibit IR(s) comprising production of pro-inflammatory cytokines IL-8, MCP-1, and IL-6; hematopoietic stem cells, in which IR(s) comprise production of pro-inflammatory cytokine IL-1p, production of GM-CSF; epithelial stem cells which express TLRs and exhibit IR(s) comprising DOS production of immunomodulator factors and antimicrobial peptides; intestinal stromal cells, microglial cells, and fibroblasts (in which IR(s) comprise production of antimicrobial peptides, cytokines, chemokines, and growth factors). CEPESCs can induce DOS IR(s) in OSMGAOA of such cells. In these and other AOTIs, IR(s) also or alternatively can comprise DOS induction of immunometabolism effects in ICs, non-ICs, or both. In aspects, IR(s) in non-IC(s) comprise memory immune responses. Aspects of IR(s) in non-IC(s) including memory responses therein are described in, e.g., Hamada A, et al. Front Microbiol. 2019; 9:3225.

3. Multi-Faceted IR(s)

In aspects, CEPESCs result in DOS induction/enhancement of IR(s) in TCs, BCs, and ITICs. In aspects, such IR(s) in ITIC(s) comprise IR(s) in DCs, NKCs, or both. In aspects, such TC IR(s) comprise DOS CD8 and CD4 IR(s). In aspects, such IR(s) also comprise DOS induction of adaptive memory IR(s) and innate trained memory IR(s). In such aspects, CEPESC(s) typically comprise ITICIMs, such as ITICITIMs, such as ITICSTAPs, e.g., EAT-2 PPTs or EAT-2 PPTs and SAP PPTs; MHCI and MHCII TCEs; and gDPs; and optionally comprise other features such as Ag-associated PTPS(s), and are expressed from NSs comprising EEI(s) and associated with TFA CaPNPs. In aspects, CEPESC(s) induce IR(s) that are DOS greater in at least one such facet (BC IRs, CD4 TC IRs, CD8 TC IRs, ITIC IRs (or DC IRs or NKC IRs)) than arising from corresponding Ag(s), Ag-expressing DNA vaccines, or even Wistar Art constructs lacking such features.

4. Immunological Memory

As DEH, AOTI include DOS induction of immune memory IR(s). In aspects, delivery of EA(s) of CEPESC(s) induces memory IR(s) that are DOS improved as compared to corresponding PPT Ag(s), DNA vaccines encoding such Ag(s), or even Wistar Art constructs lacking the features of CEPESCs OTI. In aspects, such IR(s) comprise a DOS increase in the number of ICs that exhibit a memory phenotype. In aspects, such IR(s) comprise a DOS faster IR(s), more extensive IR(s), or both, when the TR is re-challenged with a DCA or similar DCA. In aspects, memory IR(s) comprise adaptive memory IR(s) (e.g., enhanced numbers of memory T cells). In aspects, memory IR(s) comprise innate trained memory IR(s) (e.g., enhanced memory NKC IRs, enhanced memory DC IRs, or other enhanced ITIC IRs, such as memory macrophage IRs). In aspects, memory IR(s) comprise both adaptive memory IR(s) and ITIC memory IR(s). In aspects, memory IR(s) include non-IC memory IR(s). In aspects, memory ITIC(s) exhibit epigenetic or transcriptional reprogramming change(s) that reflect a memory immunity state (e.g., histone modifications). Such aspects of ITIC memory adaptable to such AOTI are described in Hajishengallis G, et al. Adv Exp Med Biol. 2019; 1197:11-26. In aspects, memory IR(s) comprise DOS enhancement in memory BC IR(s), such as faster or enhanced Ab production to re-challenge with a DCA. In aspects, memory IR(s) are greater than initial response(s) (e.g., anti-DCA Ab concentration is greater in a memory BC IR). In aspects, such greater memory IR(s) is/are at least 5×, at least 10×, at least 20×, at least 40×, at least 50×, at least 75×, at least 90×, at least 100×, at least 200×, at least 500×, at least 750×, or even about 1000× initial IR(s), in aspects being maintained after other signs of IR subside. In aspects, memory IRs comprise increases of types of memory ICs of at least 5%, at least 10%, or more, in aspects after initial IRs subside. In aspects, memory IR(s) comprise DOS enhanced population of memory phenotype IC(s), even after initial IR(s) have subsided. In aspects, challenge of CEPESC vaccinated TRs with antigen(s), DNA vaccine, or the like results in a DOS mTC response within about 5 days of such challenge, optionally followed by a mBC response maximizing around 1 month after such challenge. In AOTI, memory BC IR(s) comprise production of Abs with higher affinity for Ag(s) than initial IR. In aspects, memory IR(s) comprise DOS enhanced levels of effector memory T cells, central memory TCs, resident TCs, or combinations. In aspects, memory IR(s) comprise memory IR(s) in gamma delta TCs. In aspects, memory IR(s) comprise enhanced CTL IR(s) as compared to initial CTL IR(s). In aspects, memory IR(s) are exhibited in non-ICs. In aspects, such memory IR(s) comprise accelerated wound healing. In aspects, EA(s) of CEPESC(s) DOS enhance NKCs with memory markers, such as DOS enhanced CXCR6 expression, FcγR (including CD16) expression, Ly49H expression, but lacking/lower expression of intracellular y-signaling chain and KLRG1-. In aspects, memory IR(s) include DOS increases in number of TCs with memory phenotypes/markers (e.g., $CD127^{hi}KLRG\text{-}1^{lo}CD62L^{hi}Bcl\text{-}2^{hi}$). In aspects, memory IRs induced by EA(s) of CEPESC(s) comprise multiple-facets of memory IR(s), such as combinations of SMOA of memory TCs, memory BCs, memory DCs, memory NKCs. Such aspects of memory IR(s) that can be generated by EA(s) of CEPESC(s) and various assays for establishing levels of memory IR(s) are described in T. V. Chirkova, et al. Clinical and Vaccine Immunology September 2011, 18 (10) 1710-1718; Hole, C. R et al. Nat Commun 10, 2955 (2019).; Plotkin S A & Mortimer E A. Eds., 1994. Vaccines. Second Edition, WE Saunders, Philadelphia; Olson et al. *Am. J. Vet. Res.* 49, 1460-1466 (1988), Sprent et al. Science 265, 1395-1400 (1994), Alderink et al. *Am. J. Vet. Res.* 207, 1016-1018 (1995) Schultz (1995), Smith *Am. J. Vet. Res.* 207, 421-425 (1995); Alderink et al. *J. Am. Vet. Med. Assoc.* 207, 1016-1018 (1995); Dodds *Proc. Am. Holistic Vet. Med. Assoc.* 74-80 (1995); Dodds *Vaccine Related issues In Complementary and Alternative Veterinary Medicine,* A. M. Schoen & S. G. Wynn, eds. pp. 701-702 (1997); & Scott et al. *Feline Pract.* 25, 12-19 (1997), Blumerman S L et al. *Eur J Immunol.* 2007; 37(5):1204-1216; Samji T et al. *Immunol Lett.* 2017; 185:32-39; Paust S, Blish et al. *J Virol.* 2017; 91(20):e00169-17; Boraschi D et al. Front Immunol. 2018; 9:799; O'Sullivan T E et al. *Immunity.* 2015; 43(4):634-645; & US20050220815.

4. Efficacy of IR(s)/Analytical Methods

The various IR(s) that can be induced by EA(s) of CEPESC(s) can be measured by any suitable technique. Such methods are known and, accordingly, only briefly discussed here. Well-known methods include use of flow cytometry, target cell lysis assays (e.g., chromium release assay), the use of tetramers, and others. The detection of DOS IR(s) by these and any other described similar method each represents a separate AOTI. In aspects, DOS IR(s) are established by assaying Ab production, measuring IC proliferation, measuring release of cytokines, measuring expression of cell surface markers (e.g., by flow cytometry), measuring cytotoxicity, and the like. BC IRs can be assessed by, e.g., immunoblotting (detecting membrane-bound proteins), including dot blotting, immunohistochemistry (cell or tissue staining), enzyme immunoassays, immunoprecipitation, immunohistochemistry, RIA (radioimmunoassay), and other EIAs (enzyme immunoassays), such as ELISA. Other relevant methods adaptable to AOTI include chromium release CTL assay, PBMC and blood screening, tumor screening methods, fluorescence immunostaining, phagocytosis analysis, cytokine and chemokine analysis, or virus neutralization assays. Flow cytometry methods can identify ICs comprising markers of immune activation, immune memory, tolerance, and the like, and can be applied to DCs, NKCs, CD8 TCs, CD4 TCs, CD4CD8 TCs, BCs, macrophages, monocytes, and non-ICs, examining for markers such as, FoxP3, perforin, and the like. Methods and principles described in, e.g., —Lugli E et al. Cytometry A. 2010; 77(7):705-713 and iMontante S, et al. Int J Lab Hematol. 2019; 41 Suppl 1:56-62. ELISpot assays also can be used to assess IR(s) as exemplified elsewhere here and described in, e.g., Dittrich M., Lehmann P. V. (2012) Statistical Analysis of ELISPOT Assays. In: Kalyuzhny A. (eds) Handbook of ELISPOT. Methods in Molecular Biology (Methods and Protocols), vol 792. Humana Press, Totowa, N.J.; Schmittel et al. (2001) J Immunol Meth 247(1-2): 17-24, U.S. Pat. No. 5,750,356; & U.S. Pat. No. 6,218,132. Tetramer assays also can be used to assess IR(s) and are discussed in, e.g., Skinner et al. (2000) J Immunol 165(2):613-7. Other relevant methods are described in HANDBOOK OF IMMUNOBLOTTING OF PROTEINS, Vol. 2, Zoa (1995) DIAGNOSTIC IMMUNOPATHOLOGY: LABORATORY PRACTICE AND CLINICAL APPLICATION, Cambridge University Press, Diamond (2000) PROTOCOLS IN FLOW CYTOMETRY AND CELL SORTING, Springer Verlag, Jaroszeki (1998) FLOW CYTOMETRY PROTOCOLS, 1st Ed., Shapiro (1995) PRACTICAL FLOW CYTOMETRY, 3rd edition, Rieseberg et al. (2001). In aspects, IR(s) comprise DOS increases in OSMOA of such measures.

5. Clinical Effects

In aspects, delivering EA(s) of CEPESC(s), alone or AAW AACs, results in DOS CE(s) in TR(s). In aspects such CE(s) contribute to treating or preventing a DCA-associated disease or a condition in TR(s).

In aspects, CEPESCs are delivered as a prophylactic method (a vaccination/immunization method). In such methods TRs typically do not display signs or symptoms of a disease or displays only early signs or symptoms of a disease. In such aspects, CE(s) comprise diminishing, preventing, or decreasing the risk of developing the DCA-associated disease.

In aspects, CEPESCs are delivered to TRs to therapeutically treat an individual in need thereof. Such TRs typically display symptoms or signs of disease and CE(s) comprise diminishing or eliminating those signs or symptoms of disease in the TR.

In aspects, CE(s) associated with delivery of EA(s) of CEPESC(s) comprise reducing the incidence of a DCA-associated disease (e.g., a pathogenic disease or cancer) in TR(s); ameliorating symptoms of a disease; increasing survival or chances of survival (e.g., as determined by significant results in clinical study(ies)); stabilizing/halting reducing or minimizing progression of a disease; inducing, expediting or enhancing a state of remission or recovery; enhancing the efficacy or protective effects of CCCs/AACs; decreasing the number or frequency of relapse episodes; increasing latency between symptomatic episodes; reducing the severity, extent, or duration of episodes/disease/symptoms; reducing the number of symptoms or ameliorating symptoms; or combinations.

In aspects, delivery of CEPESCs are AW DOS reduced AE(s) as compared to corresponding PPT Ag compositions, DNA vaccines lacking most/generally all of CEPESCs OTI, or even Wistar Art constructs lacking SMGAOA of features of CEPESCs OTI not included in the Wistar Art such as ITICSTAP EP(s) (e.g., EAT-2 PPT(s)), deimmunized EP(s) (e.g., BCE removal variants, GSRV(s), etc.), CD4 and CD8 TCEs, modified gDP(s), Ag-associated PTPS(s), NAV deliver vehicle(s), and NAV-associated CaPNP(s). In aspects, Grade 3 AEs (severe AE(s)), Grade 4 AEs (life threatening/disabling AE(s)), or both, or serious grade 3/4 AEs-SAEs) associated with CEPESC(s) are less than 25%, less than 20%, less than 15%, less than 12%, less than 10%, less than 8%, or less than 5% in TR(s) (e.g., as determined by 1-4, e.g., 2-3 clinical studies). Grading of AEs is described in US FDA and other guidance materials (SFE Smit et al. Journal of Clinical Oncology 2017 35:15_suppl, 2544-2544). Other AOTI relating to safety of CEPESCs (e.g., low occurrence of cytokine storm events) are DEH.

In aspects, CEPESCs are delivered to TR(s) prior to occurrence, emergence, or detection of a DCAAD. In aspects, TR(s) lack any history of autoimmune disease or cancer prior to initial CEPESC delivery. In aspects, TR(s) lack any history of pathogen infection prior to treatment with a pathogen Ag-expressing CEPESC. In aspects, EA(s) of CEPESC(s) are administered therapeutically, e.g., to a subject who has a preexisting condition, e.g., a subject who is infected with a pathogen, has a cancer, or both.

b. Reduced Cytokine Storm/VAERD Risks

In aspects, CEPESCs comprise one or more features that DOS reduce cytokine expression-associated AEs (CEAAEs) in TR(s) and methods of delivering CEPESCs can comprise steps to reduce risk of CEAAE(s), including delivering CEPESC(s) incorporating such features. Examples of such cytokine-AE-reducing features (CARFs) associated with CEPESCs include deimmunization of OSMGASAOA EP(s) of CEPs, e.g., by GSRVs, elimination of non-DCA associated BCEs; or combinations; selection of Ag(s) to primarily, generally, or at least substantially direct TC IRs, e.g., to Th1 TC IRs or CD4 Th1 TC IRs; and combinations. Methods directed to reduce CEAAE risk(s) comprise assessing TR(s) for such risk(s), monitoring TR(s) for the development of such conditions or indicators of risk factor(s) for such conditions, and changing dosing regimens, medicament(s), applying AACs, or combinations thereof in response to incurring conditions associated with CEAEE(s) or risk of CEAEE development. In aspects, such CEPESCs, methods, or combination of both ACB DOS reduced cytokine-related AEs than treatment with compositions lacking present CARF(s), methods lacking CEAEE-risk reduction step(s) or lacking any employed combinations. In aspects, such reduced risks comprise reduce occurrence of Vaccine-Associated Enhanced Respiratory Disease ("VAERD") or conditions thereof (e.g., DOS dysregulation of proinflammatory or anti-inflammatory cytokine(s), e.g., DOS increased IL-1b levels or IL-2 levels, DOS decreased IFNa or IL-10 levels, and DOS associated AEs, e.g., DOS increased rate, duration, or severity of pneumonia, anorexia, lethargy, coughing or other respiratory disease(s), dyspnea, fever, or combinations). VAERD is known and symptoms associated with VAERD applicable to AOTI are described in Rajao D S et al. J Gen Virol. 2016; 97(7):1489-1499. doi:10.1099/jgv.0.000468; Gauger P C et al. Viral Immunol. 2013; 26(5):314-321; Gauger P C et al. Virology. 2014; 471-473: 93-104; and Guager, P. C. 2012. Iowa State University Graduate Thesis. In aspects, such methods are associated with the treatment or prevention of influenza, RSV, dengue viruses, coronaviruses, Ross River virus (RRV), human Metapneumovirus (hMPV), immunodeficiency viruses (such as HIV, SIV, or FIV), Equine Infectious Anemia virus (EIAV); measles virus; West Nile (WNV); Japanese Encephalitis virus (JEV), Lactate Dehydrogenase Elevating virus (LDEV), 64 Rabies virus (RV), Aleutian Disease virus (ADV), PRRSV, PCV, or ASFV or other pathogenic infections such as *Mycobacterium* spp., *Listeria monocytogenes*, *Coxiella burnetii* and *Salmonella* spp. & *Leishmania* spp. Other conditions similar to VAERD that can be DOS reduced by such CEPESCs and methods comprise enhanced pulmonary disease (EPD) of HMPV, enhanced respiratory disease (ERD) of RSV, atypical measles (ATM) of MV, Dengue hemorrhagic fever (DHF) or Dengue shock syndrome (DSS) of dengue virus infection, and the like. In aspects, CEPESCs exhibit DOS enhanced efficacy, DOS reduced AEs, or both in conditions CB sub-neutralizing Ab IRs, e.g., RSV, influenza, or measles virus.

5. Pathogenic Disease Treatment/Prevention

In aspects, EA(s) of CEPESC(s) are delivered to TR(s) to induce IR(s) or CE(s) against pathogen(s) or to treat or prevent pathogenic disease(s). In aspects, CEPESCs are delivered to TR(s) that have failed other treatment(s) (e.g., antivirals or antibiotics) or exhibited incomplete protection from previously administered vaccines. In AOTI, CEPESCs are delivered to TRs to treat a latent infection, such as a latent viral or bacterial infection, such as a MRSA or *Clostridium* infection. In aspects, EA(s) of CEPESC(s) DOS enhance the efficacy of AAC(s) or CCC(s), e.g., antibiotics or antivirals for therapeutic use or other vaccine(s). In aspects, pathogen(s) treated by EA(s) of CEPESC(s) comprise those pathogen(s) DEH. In aspects, delivery of EA(s) of CEPESC(s) DOS reduces spread of pathogenic DCA(s) in a population or from population-to-population or species-to-species (e.g., from dogs to humans, pigs to humans, etc.). In AOTI, CEPESC(s) provide "sterilizing immunity" against DCA(s) in DOS TR(s). Examples of such pathogen(s) include IV in various TR(s) (treated/prevented by, e.g., CEPESCs comprising H3/H1 Ag(s), or H3N8, H3N2, H1N1, H5N1, H3N1, or H1N2 Ag(s) such as NP, HA (e.g., HA stalk), or M1 Ag(s)), PCV, PRRSV, ASFV, & various forms of COV in humans or NHA(s).

Further exemplifying how AOTI DEH also provide corresponding methods of inducing IR(s), CE(s), and treating or preventing pathogenic DCAAD(s), in aspects pathogen(s) are treated or prevented in NHAs, e.g., non-HVEM NHAs, e.g., swine or cows. In aspects, such TR(s) are treated for viral pathogens, such as PRRSV (CEP(s) comprising PRRSV Ag(s) as DEH) and in aspects such CEPESC(s) are AAW other vaccines/therapeutics, such as attenuated PRRSV vaccines, a classical swine fever virus (CSFV) vaccine, pseudorabies virus (PRV) vaccine, PCV vaccine, or combination (or corresponding CEPESC(s), DNA vaccines, and the like). In aspects, CE(s) associated with such methods comprise DOS enhancement in NKC numbers/activity, cytokine expression (e.g., IL-4, IL-12, IL-10, or IFNg expression), enhanced TC population/activity; and other CE(s) such as reduced viral shedding, reduced spreading, reduced symptoms, reduced fatalities, etc. Aspects of PRRSV and effective treatment applicable to AOTI are described in Li B et al. Emerg Infect Dis. 2009; 15(12):2032-2035. doi: 10.3201/eid1512.090390. In aspects, CEPESCs induce different or enhanced anti-PRRSV IR(s) WRT Porcilis PRRS from Merck, Ingelvac PRRSFLEX EU from Boehringer Ingelheim, Amervac-PRRS from Hypra, Pyrsvac-183 from Syva, Fostera PRRS from Zoetis, Ingelvac PRRS MLV/Ingelvac, or PRRSATP from Boehringer Ingelheim or even WRT to a Wistar Art-like construct lacking feature(s) associated with CEPESC(s) OTI (e.g., enhanced nectin-1 binding, no-HVEMBD, soluble gD status, incorporation of gDSS, incorporation of PTPS(s), deimmunized Ag(s), inclusion of ITICITMs, such as ITICSTAPs, such as EAT-2 or EAT-2+ SAP, association with CaPNPs, and expression from NAM(s) comprising EEI(s). In aspects, delivering EA(s) of CEPESC(s) DOS enhances efficacy of IR(s), duration of IR(s), or both WRT pathogenic DCAs, e.g., ASFV. In aspect(s), such results are obtained with 3 administrations or less or 2 administrations or less. In aspects, such anti-ASFV CEPs comprise ASFV p32, p54 or p72 Ags or other ASFV Ag(s) DEH. In aspects, treatment or prevention of IR(s) comprises delivering CRA(s) or PCRA(s) (e.g., Ag(s) detected in association with DCA-infected cells in TR(s) or in similar subjects/patients). In aspects, delivery of such CEPESCs results in DOS enhanced DC, NKC, CTL, CD4+, and TCR-γδ T-cell responses in TR(s) as compared to use of non-CRA/PCRA Ag(s). In aspects, CEPESC(s) provide protective effects against DCA challenge or re-challenge independent of the number of exposure(s) over the lifetime of TR(s). In aspects, CEPESC(s) are administered as a treatment when a latent pathogen is detected to emerge from latency. E.g., CEPESCs comprising *Leishmania* parasite Ag(s) can be used in a CEPESC that induces significant CD4 responses and significant memory IC responses and provides significant CE(s) relating to treatment of such a condition (e.g., treatment of cutaneous leishmaniasis skin sores, visceral leishmaniasis internal organ damage, or both). In aspects, CEPESCs are administered to both human and NHA in close proximity for the same DCA, e.g., companion animals and humans living or working in proximity can receive CEPESCs comprising anti-pathogen Ag(s), such as anti-leishmaniasis Ag(s), anti-coronavirus Ag(s) or anti-influenza Ag(s), or humans and NHA livestock animals can receive CEPESCs comprising anti-PCV Ag(s), anti-PRSV Ag(s), and the like. These AOTI can be applied to/combined with AOTI relating to CEPs/CEPESCs DEH and vice versa.

6. Cancer Treatment/Prevention

In aspects, EA(s) of CEPESC(s) are delivered to treat or prevent cancer. In aspect(s), CEPESC(s) are delivered to TR(s) that exhibit preneoplastic, premalignant, or precancer (ous) conditions ("precancer conditions"). Indicators of precancer and triggers for treatment can comprise detection of differences in cells from nearby or closely related nonneoplastic counterparts that signal the onset of cancer progression, uncontrolled growth (e.g., by exceeding the "Hayflick limit"), or detection of the start of cancer progression, neoplasm(s), or preneoplastic lesion(s) (e.g., ductal carcinoma in situ (DCIS) growths in breast cancer, cervical intra-epithelial neoplasia (CIN) in cervical cancer, adenomatous polyps of colon in colorectal cancers, atypical adenomatous hyperplasia in lung cancers, and actinic keratosis (AK) in skin cancers). In aspects, TR(s) have gene expression profiles that indicate a difference between normal, precancerous, and cancer cells (e.g., familial adenomatous polyposis gene expression signaling a risk of colon cancer; mutated p53 tumor-suppressor gene indicating risk of various aggressive cancers; osteopontin expression levels indicating risk/presence of premalignant cells, and increased telomerase activity indicating a risk of cancers in the bladder, lung, or elsewhere). "Cancer progression" refers to event(s) indicative of, the transition of a normal, non-neoplastic cell to a cancerous, neoplastic cell, the migration of such neoplastic cells, and the formation and growth of tumors therefrom (tumor progression), including cell crisis, immortalization and/or normal apoptotic failure, proliferation of immortalized and/or pre-neoplastic cells, transformation (i.e., changes CBA immortalized cells exhibiting anchorage-independent, serum-independent and/or growth-factor independent, or contact inhibition-independent growth, aneuploidy, and focus formation), proliferation of transformed cells, development of metastatic potential, migration and metastasis (e.g., the disassociation of the cell from a location and relocation to another site), new colony formation, tumor formation, tumor growth, neotumorogenesis (formation of new tumors at a location distinguishable and not in contact with the source of the transformed cell(s)), and combinations thereof. Administration of CEPESCs comprising CAgES(s) to TR(s) in which any 1+ of such aspects of cancer progression is detected are AOTIs. Additional aspects of cancer progression are known and can be applied to such AOTI, such as those provided in US20070014788.

In aspects, CEPESCs comprising CAg(s) are administered to TR(s) at risk for cancer in which there is SMGAOA of (a) physical indicator(s) of cancer, e.g., palpable lumps, enlarged lymph nodes, bleeding, visible skin lesions, (b) indicators of cancer identified through imaging (X-ray techniques, mammography, colonoscopy, computed tomography (CT and/or CAT) scanning, magnetic resonance imaging (MRI), etc.); (c) indicators obtained through immunodiagnostic assays (e.g., detection of CEA, AFP, CA125, etc.) or antibody-mediated radioimaging; and (d) indicators obtained through cellular/tissue immunohistochemistry. In aspects, such indicator(s) include expression of oncogene(s), TAAs, or other CAg(s) (e.g., HER2, MAGE CAg(s), MUC1 CAg(s), TRAL CAg(s), and the like).

In aspects, delivery of CEPESC(s) reduces one or more aspect(s) of cancer progression. In cases, such aspects of cancer progression that are DOS reduce(d) include (1) rate of increase of precancer or cancer cells or markers thereof; (2) number or size of cancerous growths (lesions, tumors, and the like); (3) probability, timing, or degree of the next phase of cancer progression; (4) reduction of cancer metastasis or invasiveness; or (5) combinations. In aspects, treatment of cancer by such methods DOS results in reduction in the rate of tumor growth, cancer spread, or even reduction in tumor number, average tumor size, etc. In aspects, CE(s) related to such AOTI(s) comprise DOS prolonged survival, reduced risk of near-term fatality (e.g., in 1-5 years), reduction of symptoms associated with cancer (e.g., cancer-associated pain), improvement in quality of life, etc.

Cancers treated by such methods can include any of the various cancers DEH or otherwise known in the art. In aspects, methods comprise treating carcinoma(s) (e.g., adenocarcinoma, squamous cell carcinoma, or ductal cell carcinoma); sarcoma(s) (e.g., Ewing sarcoma); leukemia (e.g., AML, CML, CLL, SLL, or ALL); or lymphoma (e.g., NHL or DLBCL); or myeloma (e.g., multiple myeloma). Additional cancer(s) treatable or preventable by delivery of CEPESC(s) are described in references CEH (e.g., the '788 US application). In aspects, CEPESC(s) DOS treat solid tumor cancer(s) or non-tumor cancers, e.g., blood cancers or non-tumor-forming breast cancer. In aspects, CEPESC(s) treat a pathogen-associated cancer, e.g., an HPV-associated cancer.

In AOTI, CE(s) comprise DOS reducing the size of an established tumor or lesion in the subject (e.g., reducing size of a tumor or average size of tumor(s) by at least 20%, at least 30%, at least 50%, e.g., about 60-100%, about 75-100%, or about 85-100%). In AOTI, CEPESCs DOS enhance survival rate(s), survival time(s), or both, alone or AW CCEPM(s) or CCEPC(s) (e.g., increasing average survival time by least at least 3, 4, 6, 8, 9, 12, 18, 24, 30, 36, 42, 48, 54, or 60 months in TR(s) diagnosed with the relevant cancer).

In aspects, CEPESC(s) result in DOS detection of one or more predictive biomarker(s) for progression-free survival/overall survival in TR(s) treated for cancer. Examples of such biomarkers include DOS increase(s) in tumor-infiltrating lymphocyte (CD4+, CD8+) population(s), decreased neoantigen burden, decreased mutational load, reduced expression of oncogenes/CAg(s), and modifications of cancer-associated epigenetic signature(s), each of such being an AOTI.

In aspects, CEPESC(s) are used to treat a cancer is a relapsed or refractory cancer. In aspect(s), CEPESC(s) are delivered to an NHA TR that is associated with susceptibility to certain cancer(s) (e.g., golden retrievers/lymphoma, gray horses/melanoma, and other examples DEH). In aspects, CEPESCs are delivered to treat bladder cancer/TCC. In aspects, such methods are performed on humans or dogs. In aspects, CEPESC(s) comprising CAg(s) are delivered to treat lymphoma(s), e.g., in humans or in dogs. In aspects, such lymphomas are diagnosed as drug-resistant lymphoma(s) or the TR is a subject diagnosed as being of risk for developing drug-resistant lymphoma(s). In aspects, other anti-cancer agents, such as anti-cancer oncolytic virus(es) are administered in association with CEPESC(s).

In aspects, CEPESC(s) are used to treat a cancer CB immunologically hot tumors (CB relatively high amount(s) of effector IC infiltration, e.g., in a melanoma, lung cancer, head and neck cancer, etc.). In aspects, CEPESC(s) are delivered to TR(s) with a cancer CB cold tumors. In aspects, IR(s) AW delivery of CEPESC(s) include DOS initiation of TC anti-tumor IR(s), migration of IC(s) to tumor(s) (e.g., TCs, DCs, NKCs, or combinations), increased numbers of CD8 TCs (or higher ratio of CTLs/naïve CD8 TCs); and the like. In aspects, IR(s) AW CEPESC(s) comprise DOS maturation of DCs (e.g., in response to CAgES CEPESC(s) or other CEPESC(s) DEH). In aspects, CEPESCs comprise cytokine(s) or CCC(s)/CCEPC(s) comprise cytokine(s) or cytokine-expressing vectors/nucleic acid(s).

In aspects, such methods are AAW other anti-cancer therapeutic(s), e.g., chemotherapy CCEPC(s) (e.g., doxorubicin) or radiation CCEPM(s). In aspects, anti-cancer methods OTI comprise AAW anti-cancer antibodies, such as checkpoint inhibitor Abs (e.g., anti-CTLA4, anti-PD-L1, anti-PD-1, anti-IDO, anti-IDO1, anti-CD200, anti-CD137, anti-KIR2D); cytokine(s) (e.g., IL-2 or IFNa), and the like (SFE Christofi T et al. Cancers (Basel). 2019; 11(10):1472. doi:10.3390/cancers11101472). Other combinations adaptable to methods are described specifically below and in connection with CCCs & methods DEH.

In aspects, anti-cancer CEPESCs comprise neoantigen(s) (e.g., shared neoantigen(s)) or CCC(s)/CCEPC(s) comprise delivery of such antigen(s) (such as those disclosed in US20190307868 or DEH). In aspects, CAg(s) in CEPs or AAW CEPESC(s) comprise synthetic long peptide (SLP) neoantigens (Hollingsworth R E et al. NPJ Vaccines. 2019; 4:7). In other aspect(s), CEPESC(s) are administered AAW deliver of a chimeric antigen receptor-engineered T cell therapy (CAR-T) targeting cancer targets (e.g., in treatment of ALL, CLL, or B-cell lymphoma). In aspects, CEPESCs, CAg(s), or both are delivered in DCs or CEPESCs are delivered in or with CAg-pulsed DCs (e.g., neoantigen pulsed DCs) or DCs transformed to express higher than typical levels of cytokines, e.g., IL-2, GM-CSF, or CT.

In AOTI, anti-cancer CEPESC(s) comprise internal CAg(s). In aspects, SMGAOA of CAg(s) in CEP(s) are internal CAg(s). Such Ags are described in Wang Y et al. Mol Oncol. 2015; 9(10):1982-1993; Trenevska I, et al. Front Immunol. 2017; 8:1001. doi:10.3389/fimmu.2017.01001;

and Hong C W et al. FEBS Lett. 2014; 588(2):350-355 & such disclosures can be adapted to cancer treatment/prevention AOTI & composition AOTI.

In aspects, CEPESCs comprise or CCs/CCEPCs comprise FPs, such as anti-DC ICR Ab/TAA FPs. In aspects, CEPESCs comprise oncolytic viruses (e.g., recombinant oncolytic viruses, e.g., oncolytic viruses expressing cytokine(s), e.g., GM-CSF; PCM(s) (e.g., CD40L), or other IMs/adjuvant(s), such as bacterial proteins, such as HPNAP PPTs).

In aspects, CC(s)/CCEPC(s) comprise CAR-T cells, e.g., CAR-T cells targeting CD19 (in aspects, such combinations are used to treat leukemia, lymphoma, or myeloma, such as B cell lymphomas or multiple myeloma). CAR-T cells also can target HER2 or IL13R (in glioblastoma treatment) or PSMA or PSCA (e.g., in prostate cancer treatment). In aspects, CC(s)/CCEPC(s) comprise inhibitor CAR (iCAR)/activating CAR T cells, which provide negative signals when Ags are recognized on normal cells but not when they are recognized on cancer cells (e.g., CD19-CAR carrying activating signaling (CD3 and CD28) and PSMA-CAR carrying inhibitory signaling domains (from PD-1 or CTLA-4)). In aspects, CAR-T cells comprise suicide genes to eliminate the cells in the event a toxic AE arises (e.g., by incorporation of HSV-thymidine kinase (HSV-TK) or inducible-caspase-9 (iCasp9)).

In aspects, CC(s)/CCEPC(s) or CEP(s) comprise anti-angiogenic PPTs/agents, such as anti-VEGF or anti-VEGFR Abs or inhibitors (e.g., small molecule kinase inhibitors of VEGFR). In aspects, CC(s)/CCEPC(s)/CEP(s) comprise endothelial cell IR modulators, such as Fas ligand-blocking PPTs/agents. In aspects, CC(s)/CCEPC(s)/CEP(s) comprise TNF-related apoptosis-inducing ligand (TRAIL) ligand PPTs or modulators thereof. In aspects, CC(s)/CCEPC(s)/CEP(s) comprise FAP PPTs or modulators. In aspects, use of such agent(s) as described herein DOS reduce tumor growth or support (e.g., by inducing IR(s) in tumor-associated fibroblast(s), stromal cell(s), and the like). Related AOTI directed to induction of IR(s) in such cells is DEH. Such AOTI can be relevant in cancers in which the relative proportion of malignant cells in tumors is relatively low, as is often the case in cancers. In aspects, CC(s)/CCEPC(s)/CEP(s) comprise PPTs/agents that block TC suppressive cytokine(s), e.g., IL-4, IL-10 and TGFb.

In aspects, CCEPC(s)/CC(s) comprise delivery of agents that selectively silence cancer-related genes/PPTs in cancer cells, such as siRNA, antisense, CRISPR-Cas9 mediated silencing of such factors (e.g., silencing of PD-L1 on tumor cells (e.g., clinical trial agents NCT02793856, NCT02863913). In aspects, other anti-cancer siRNA, CRISPR, or antisense compositions are delivered as CCEPC(s)/CC(s), e.g., antisense oligonucleotides or siRNA that reduce the expression of oncogenes or other cancer progression-related genes (SFE US Patent Application 2003224993 and O'Toole et al., Exp Cell Res. 1997 Jun. 15; 233(2):330-9; and Giles et al., J Cell Sci. 2001 August; 114(Pt 16):2967-76)). In aspects, CC(s)/CCEPC(s) comprise anti-cancer aptamers. Such agents are described in, e.g., Kim M et al. *Molecules*. 2018; 23(4):830. doi:10.3390/molecules23040830 and Morita Y, et al. Cancers (Basel). 2018; 10(3):80.

In aspects, CC(s)/CCEPC(s) comprise anti-cancer Abs, such as Herceptin, cetuximab, (REMICADE®), and adalimumab (HUMIRA™), anti-CD94/NKG2A antibodies (see, for example, U.S. 20030095965), and Anti-kir antibodies (US20150344576).

In aspects, CC(s)/CCEPC(s)/CEP(s) comprise gut microbial/non-microbial ligands. In aspects, such ligands induce DOS adaptive IRs to pathogens, cancer, or both. In aspects, CC(s)/CCEPC(s) comprise immunomodulatory metabolites, such as short-chain fatty acids (e.g., butyrate, acetate, & propionate) or secondary bile acids. In aspects, CC(s)/CCEPC(s) comprise commensals such as *Bacteroides, Lactobacillus*, & *Bifidobacteria*.

In aspects, CCEPM(s) comprise anti-cancer surgery, bone marrow transplant, or application of anti-cancer radiotherapy (e.g., external beam radiation therapy (EBRT) or brachytherapy (BT)), or both. Cytotoxic radiotherapy can comprise application of suitable radioactive isotopes (e.g., $At^{211}$, $I^{131}$, $I^{125}$, $Y^{90}$, $Re^{186}$, $Re^{188}$, $Sm^{153}$, $Bi^{212}$, $Ra^{223}$, $P^{32}$, and radioactive isotopes of Lu).

In aspects, CC(s)/CCEPC(s) comprise chemotherapeutic agent(s) (e.g., antitumor agents such as doxorubicin, paclitaxol, a cyclophosphamide, etoposide, 5-fluorouracil, methotrexate, and the like). In aspects, such agents are alkylating agents, antimetabolites, cytotoxic antibiotics, hormonal agents (e.g., anti-estrogens, other anti-androgens) other aromatase inhibitors, and other progestogens. In aspects, such agents are ell cycle control/apoptosis agents, growth factor inhibitors, angiogenesis inhibitors, or vinca alkaloids. Exemplary chemotherapeutic agents for combined therapy are listed in Table C of U.S. Pat. No. 6,524,583. In aspects, chemotherapeutic agent CC(s)/CCEPC(s) comprise alkyl sulfonates, aziridines, nitrogen mustards, nitrosureas, mitomycins, anti-metabolites (e.g., methotrexate and 5-fluorouracil (5-FU)), folic acid analogues, pyrimidine analogs, androgens, maytansinoids, platinum analogs, retinoids (e.g., ATRA, Targretin, 9-cis RA, alone or in combination with DNA methyltransferase or histone deacetylase inhibitors), or combinations, e.g., CHOP (combined therapy of cyclophosphamide, doxorubicin, vincristine, and prednisolone) and FOLFOX. In aspects, chemotherapeutic agents comprise cytotoxic agent(s), such as maytansinoids, taxol, cytochalasin B, gramicidin D, methotrexate, doxorubicin, melphalan, chlorambucil, daunorubicin or other intercalating agents, nucleolytic enzymes, benzodiazepine, and toxins (e.g., bacterial toxins).

In aspects, CC(s)/CCEPC(s) comprise prodrugs of anti-cancer agents, such as chemotherapeutic agents (SFE Wilman, "Prodrugs in Cancer Chemotherapy" Biochemical Society Transactions, 14, pp. 375-382, 615th Meeting Belfast (1986)).

In aspects, CC(s)/CCEPC(s) comprise chemotherapeutic conjugates, e.g., PPT-chemotherapeutic derivatives. E.g., such compounds can comprise an Ab derivative comprising an Fc portion and a chemotherapeutic agent.

In aspects, CC(s)/CCEPC(s) comprise 1+ Btk inhibitors, TEC inhibitors, Itk inhibitors, PD-L2 Inhibitors, PD-1 inhibitors, CTLA-4 Inhibitors, CD 137 Inhibitors, PS Inhibitors, CD52 Inhibitors, CD30 Inhibitors, CD20 Inhibitors, CD27 Inhibitors, ICOS Inhibitors, or other immunomodulators/anti-cancer agents described in WO2016161347.

As described in WO2017053823, agent(s) effective for the specific cancer(s) targeted by CEPESCs and methods OTI are known. E.g., CCCs/CCEPCs for bladder cancer treatment comprise doxorubicin hydrochloride (Adriamycin PFS/RDF), cisplatin, mitomycin, fluorouracil, gemcitabine, methotrexate, vinblastine, carboplatin, paclitaxel, docetaxel, thiotepa (Thioplex, Tepadina), immunotherapeutic agents (e.g., Bacille Calmette-Guerin, interferon alfa-2b), and radiation therapeutic agents.

Additional anti-neoplastic agents that can be used in the combination composition and combination administration methods of the invention include those described in, e.g., WO2019071123, WO2019079297, US2019029068, US20190152949, US20200017471, US20200016250, WO 2003070921, and Ramachandran M et al. Semin Cancer Bio. 2017; 45:23-35.

Any aspect of anti-cancer methods & CEPESCs described here that can be applied to anti-pathogen compositions & methods can be and vice versa.

ILLUSTRATIVE APPLICATIONS (EXAMPLES)

To even further exemplify and illuminate aspects of the invention, the following description of illustrative applications of particular aspects of the invention are provided. These Examples are meant to exemplify particular facets of the invention but should not be used to limit its scope whatsoever.

I. General Methods

Methods described herein are known to those of skill in the art, but exemplary applications of such methods or brief descriptions thereof are provided in the following passages or references cited therein.

Many of the Examples provided herein comprise the isolation and use of peripheral blood mononuclear cells (PBMCs—sometimes also referred to as PBMC), isolation of immune cells from PMBCs, and flow cytometry or other types of analysis of such cells. Many PBMC isolation methods, methods for obtaining immune system cells from PBMC, flow cytometry and other analytical methods are known in the art (SFE Grievink H W, Luisman T, Kluft C, Moerland M, Malone K E. Comparison of Three Isolation Techniques for Human Peripheral Blood Mononuclear Cells: Cell Recovery and Viability, Population Composition, and Cell Functionality. Biopreserv Biobank. 2016; 14(5): 410-415. doi:10.1089/bio.2015.0104; Riedhammer C, Halbritter D, Weissert R. Peripheral Blood Mononuclear Cells: Isolation, Freezing, Thawing, and Culture. Methods Mol Biol. 2016; 1304:53-61; Raulf-Heimsoth M. T cell—primary culture from peripheral blood. Methods Mol Med. 2008; 138:17-30; Rahmoune H, Guest P C. Studies of Isolated Peripheral Blood Cells as a Model of Immune Dysfunction. Methods Mol Biol. 2018; 1735:221-229; Gerner W, K8ser T, Pintaric M, Groiss S, Saalmuller A. Detection of intracellular antigens in porcine PBMC by flow cytometry: A comparison of fixation and permeabilisation reagents. Vet Immunol Immunopathol. 2008; 121(3-4):251-259; Yancy H, Ayers S L, Farrell D E, Day A, Myers M J. Differential cytokine mRNA expression in swine whole blood and peripheral blood mononuclear cell cultures. Vet Immunol Immunopathol. 2001; 79(1-2):41-52; Piriou L, et al. Cytometry. 2000; 41(4):289-297; Summerfield A et al. Immunology. 2003; 110(4):440-449; and Berg C, Wilker S, Roider J, Klettner A. Vet Res Commun. 2013; 37(3):239-241.

Methods of TCE identification employed in this analysis can include techniques described in, e.g., Stevenson, P. G., and Doherty, P. C. 1998. Cell-mediated immune response to influenza virus. In Nicholson, K. G., Webster, R. G., and Hay, A. J., eds., Textbook of Influenza, pp. 278-287. Blackwell Science, Oxford and Klausman, PCV-induced T cell clonal deletion in thymus, Emerging Microbes and Infections (2015) 4, e15.

II. Example 1—PCV

In this example, the test subjects are pigs and antigenic sequences encoding antigenic sequences known or predicted to induce immune responses against porcine circovirus type 2 (referred to as PCV2 or PCV-2) are used to test constructs and methods of exemplary aspects of this invention. As is known in the art, PCV2 is a small DNA virus with a circular genome of approximately 1700 bp, encoding four Open Reading Frames (ORF1, ORF2, ORF3, and ORF4). T cell epitope analysis of these sequences is performed using methods described in this Section of the disclosure, which may be optionally supplemented by other methods, examples of which are provided in the Detailed Description Section of the disclosure.

Porcine dendritic cells, T cells, and B cells are isolated from porcine PBMCs. Human embryonic kidney cells (HEK293 cells, well known in the art and available through several public sources), Vero cells, and canine thymus cells are obtained to use as controls.

Synthetic peptide panels from PCV2 ORF expression products (including whole ORF expression products) are generated and used to query PBMC from PCV2 infected pigs to identify potential CRAs. These synthetic peptides are used in expression library immunization (ELI) methods employing sets of the synthetic peptides representing portions of the PCV2 genome.

ELI is generally understood as the use of an expression library constructed from the complete or partial DNA complement of a pathogen to immunize a host, typically without the risk of infection (SFE Barry, M. A., Lai, W. C. and Johnston, SA (1995) Nature (London) 377, 632-635). Examples of ELI methods are described in, e.g., Talaat A M, Stemke-Hale K. Expression library immunization: a road map for discovery of vaccines against infectious diseases. Infect Immun. 2005; 73(11):7089-7098; Barry M A, Howell D P, Andersson H A, Chen J L, Singh R A. Expression library immunization to discover and improve vaccine antigens. Immunol Rev. 2004; 199:68-83; and Lacasta A, Ballester M, Monteagudo P L, et al. Expression library immunization can confer protection against lethal challenge with African swine fever virus. J Virol. 2014; 88(22):13322-13332. Panels of synthetic overlapping peptides representing ORFs 1, 2, 3 and 4 are used to query PBMC from naturally infected pigs to identify T cell targets. PCV2 and PCV3 have very small genomes so ELI is feasible for CRA screening. In some cases, CRAs are modified to generate putative editopes; e.g., putative editopes can be generated by preparing nucleotide sequences encoding antigenic variants edited for de-glycosylation, a removal method known to enhance immunogenicity to PCV and other viruses.

Any clinically relevant antigens identified through the ELI step are then sequenced, nucleic acids encoding the CRA(s) are prepared or isolated from PCV2, and CRA-containing construct(s) are generated in a similar manner to the two specific constructs described below in this Example. It is anticipated that one or more polyepitope-encoding DNA sequences will be generated from the ELI screen and expression of PCV2 ORFs or portions thereof.

The antigen-encoding sequences identified in the ELI screen are cloned into suitable plasmid vectors, in association with one or more gD-domain-encoding sequences to express a gD:antigen fusion protein and/or independently. In gD:antigen fusion protein-encoding constructs, the antigen-encoding sequences are positioned between nucleotide sequences encoding (1) a first gD sequence comprising residues 23-244/267 of HSV-1 gD (gD1 seq 1) and (2) a second gD amino acid sequence that comprises residues 245/268-340/392 of HSV-1 gD-1 (gD1 seq 2). A sequence encoding SEQ ID NO: 1 (a polyubiquitin chain) is optionally positioned upstream of gD-1 sequence 1 in the fusion protein coding nucleotide sequence. Also or alternatively, the fusion protein can include a T2A cleavage site, such as a single T2A site downstream of gD1 seq 2. In a possible variation or extension of this plan, one or more sequences encoding variants of an above-described gD1 seq 1 sequence in which residues associated with HVEM binding and that do not impact binding to Nectin-1 and homologous receptors are removed and also used in separate constructs or replace gD1 seq 1 in the experimental plan.

In addition to sequences encoding CRAs identified in the above-referenced step, a sequence encoding the glycosylation site removal editope, ORF2Δ143-145, also is prepared, for insertion into plasmid vectors.

Such plasmid vectors will likely include an expression-enhancing intron, such as a CMV Intron A sequence, and a strong constitutive promoter, such as a CMV IE promoter. The plasmids will further likely comprise a reporter gene (e.g., a GFP sequence) and a non-antibiotic resistance system, such as a triclosan selection system described elsewhere herein. Cloning of plasmid containing cells can then be performed on triclosan media. The method can also comprise confirming reporter gene expression in culture to ensure proper levels of expression are occurring in vitro, in vivo, or both.

Isolated DNA plasmids are mixed with calcium phosphate nanoparticles using methods described in the Detailed Description of the Invention to form DNA:CaPNP complexes prior to vaccination of test subjects. Such vaccination is administered intranasally. Constructs to be tested in healthy animals (which will be subsequently assessed for PCV2 protection or challenged with PCV2) or PCV2-infected animals will include the following coding sequences: (a) gD1 seq 1:PCV2 CRA:gD1 seq 2 (e.g., SEQ ID NO: 1-gD seq 1-PCV2 CRA-gD seq 2-T2A SCS); (b) gD1 seq 1:ORF2Δ143-145 gD1seq 2; (c) ORF2Δ143-145; and (d) PCV2 CRA.

In some cases, nucleotide sequences encoding one or more known or putative B cell epitopes from PCV2 ORF2 (which encodes the PCV2 capsid protein) are also (1) incorporated directly or indirectly (via cleavage site or linker) to the fusion protein-coding sequence, (2) separately expressed from the fusion protein-encoding nucleotide sequence-containing DNA plasmid (e.g., as a bicistronic plasmid), or encoded in a separate DNA plasmid that is administered with or in association with the fusion-protein-encoding sequence containing DNA plasmid. Examples of relevant putative epitopes are described in, e.g., Guo L, Lu Y, Huang L, Wei Y, Liu C. Identification of a new antigen epitope in the nuclear localization signal region of porcine circovirus type 2 capsid protein. Intervirology. 2011; 54(3): 156-163 and Shuai J, Wei W, Li X, et al. Genetic characterization of porcine circovirus type 2 (PCV2) from pigs in high-seroprevalence areas in southeastern China. Virus Genes. 2007; 35(3):619-627, as well as in Chinese Patent Applications CN110423269A and CN110407919A. Alternatively, endogenous humoral responses to selected putative vaccine antigens in chronically infected pigs can be used to identify antigens that result in a sufficient humoral response by collecting serum and evaluating by virus neutralization against selected PCV strains e.g., PCV2a/b or PCV2d. Alternatively, ELISA can be performed using these sera and purchased or synthetic antigens (e.g., ORF2 at a minimum).

In addition, nucleotide sequences encoding a PD-L1 antagonist (e.g., a PD-L1 trap protein as described in the Detailed Description or a PD-L1 sequence obtained based on the disclosure of Richmond O, Cecere T E, Erdogan E, et al. PD-L1 expression is increased in monocyte derived dendritic cells in response to porcine circovirus type 2 and porcine reproductive and respiratory syndrome virus infections. Vet Immunol Immunopathol. 2015; 168(1-2):24-29) and an EAT-2 polypeptide (e.g., human, murine or porcine EAT-2, also as described in the Detailed Description) are obtained and either cloned into the same DNA plasmid vector as the above-referenced antigen-encoding sequences or into a separate expressible CaPNP-complexed DNA plasmid vector that it is co-administered with the above-described antigen sequence-encoding DNA plasmids (in at least some cases), such that the test subjects receive the following sequences in administered DNA plasmid(s): (a) gD1 seq 1:PCV2 CRA:gD1 seq 2; (b) gD1 seq 1:PCV2 CRA:gD1 seq 2+ EAT-2; (c) gD1 seq 1:PCV2 CRA:gD1 seq 2+PD-L1 antagonist (PD-L1a); (d) gD1 sequence 1:PCV2 CRA:gD1 sequence 2+PD-L1a+EA; (e) EAT-2; (f) PCV2 CRA; (g) PCV2 CRA+ EAT-2; (h) PCV2 CRA+PD-L1a; (i) PCV2 CRA+PD-L1a+ EAT-2; j) gD1 seq 1:ORF2Δ143-145: gD1 seq 2; (k) gD1 seq 1:ORF2Δ143-145:gD1 seq 2+ EAT-2; (l) gD1 seq 1:ORF2Δ143-145:gD1 seq 2+PD-L1a; (m) gD1seq 1:ORF2Δ143-145:gD1seq 2+PD-L1a+ EAT-2; (n) ORF2Δ143-145; (o) ORF2Δ143-145+ EAT-2; (p) ORF2Δ143-145+PD-L1a+ BCEs; and (q) ORF2Δ143-145+ PD-L1a+ EAT-2+ BCEs Alternative versions of constructs that can be generated and tested from identified T cell antigen-encoding sequences are: (i) gD-singleORF (fragment or native); (ii) gD-multi-ORF (fragments of more than one PCV-ORF; (iii) gD-Editope (e.g., native antigen or fragment with glycosylation site(s) deleted); (iv) singleORF (fragment or native); (v) multiORF (fragments of more than one ORF) or (vi) GSRAgV/editope (e.g., native Ag or fragment with glycosylation site(s) deleted).

The method can further include generation of mixtures of two or more of these types of construct-containing plasmids either in the first instance or in further iterations of the experimental method.

Endotoxin-free gigapreps are prepared for clinical studies (e.g., using GenElute™ HP Endotoxin-Free Plasmid Megaprep Kit—Millipore Sigma, St. Louis, Mo., USA) comprising 7-10 mg of each candidate (an amount sufficient for pilot safety/challenge study) & formulated appropriately.

Each of the above-described treatments are provided to a group of at least 5 pigs per group. The plasmid compositions are delivered by mucosal administration of 1-2 mL of a formulation for vaccination comprising 1-200 micrograms of plasmid. Single vaccination will be employed in this study (but repeat administration can be used, e.g., one or two doses administered every 2-8 weeks). A vaccination trial is expected to include a safety phase to assess safety of the constructs for a suitable period, such as 7 days. Viral challenge is expected to take place at three to six weeks after administration. Viral challenge may be repeated with different stains of PCV-2, in order to identify constructs that are protective against a number of PCV types. Candidate strains for the challenge study can include some or all of the following—

1. PCV2d isolate JX535296 Opriessnig 2017, GenBank accession numbers JX679498 and JQ653449; Opriessnig 2014 J Gen Virol (Opriessnig T, Xiao C T, Gerber P F, Halbur P G, Matzinger S R, and Meng X J. J Gen Virol. 2014; 95(Pt 11):2495-2503);

2. PCV2 strain GDYX deposited in GenBank under the accession number JX519293; Chen et al 2012 J Virol (Chen F, Pan Y, Liao C, et al. J Virol. 2012; 86(22):12457-12458); and 3. PCV2 Isolate D3276/5/16HU; (GenBank accession number: MG833033; Palya et al 2018 Virol J (Palya V et al. Virol J. 2018; 15(1):185).

In a possible variation of the above-described method, PCV3 antigenic sequences are also or alternatively included in the test constructs (e.g., where a broader PCV/Circovirus vaccine is sought or to employ similar principles for the development of a PCV3 vaccine comprising such a construct but with one or more PCV3 CRAs). Candidate strains that also or additionally can be used for such a PCV3 or combined PCV vaccine study include:
1. PCV3/CN/Hubei-618/2016 deposited at GenBank under the accession number KY354039; Fan et. al. Genome Announc. 2017 (Fan S, Ku X, Chen F, Wang Y, Yu X, He Q. Genome Announc. 2017; 5(15):e00100-17. Published 2017 Apr. 13);
2. GenBank Accession Number KX458235; Palinski et. al. J. Virol. 2016 (Palinski, R., Pineyro, P., Shang, P., Yuan, F., Guo, R., Fang, Y., Byers, E. and Hause, B. M. J. Virol. 91(1) (2016) PUBMED 27795441);
3. GenBank Accession Number KY996344; Kwon et. al. Vet. Microbiol. 2017 (Kwon, T., Yoo, S. J., Park, C. K. and Lyoo, Y. S. Vet. Microbiol. 207, 178-180 (2017) PUBMED 28757021); &
4. GenBank Accession Number MG014362; Fux, et. al. Virol J. 2018 (Robert Fux, Christina Söckler, Ellen Kathrin Link, Christine Renken, Roman Krejci, Gerd Sutter, Mathias Ritzmann, Matthias Eddicks. Full genome characterization of porcine circovirus type 3 isolates reveals the existence of two distinct groups of virus strains. Virol J. 2018; 15: 25. Published online 2018 Jan. 29).

PBMC are harvested at −7, 0, 7, 14, 21, 42 and optionally 56 days. PBMC will be analyzed by flow cytometry for CD4+, CD8+, NK cell, dendritic cell, gamma-delta T cell and regulatory T cell responses to vaccine antigens, or alternatively analyzed by analytical methods capable of producing similar or equivalent data, such as ELISpot analysis. Serum is collected at days 14, 21, and 42 and is used to measure antibody responses.

A third, challenge phase can further be conducted, with timing, strain selection and sample collection protocols to be determined. The performance of the vaccine candidates will be compared to at least one commercial PCV vaccine.

It is expected that several of the plasmids/constructs described above will result in a measurable and often significant B cell and T cell response to PCV, and that at least some of the constructs/plasmids will result in significant B cell and T cell responses to more than one type of PCV.

III. Example 2—PRRSV

In this example, nucleotide sequences encoding gD1 seq 1 and/or gD1 seq 2 and an intervening PRRSV antigenic sequence are prepared and inserted into a DNA plasmid, which may comprise sequences encoding a ubiquitin (e.g., SEQ ID NO: 1) (typically positioned upstream of the antigen (for example, if gD is located at the C terminus) or gD seq 1), a T2A cleavage site (typically positioned downstream of gD1 seq 2), or both, and optionally including a CMV Intron A sequence and a strong constitutive promoter, such as CMV IE. The DNA plasmids are associated with CaPNP particles and formulations are administered to pigs using treatment and analytical approaches described in Example 1 (e.g., flow cytometric or ELISpot analysis of PBMC drawn and ELISA analysis of sera collected on the days indicated in Example 1). The three antigenic sequences tested both on their own and in the context of the gD1 seq 1-gD1 seq 2 fusion protein are—

```
PRRSV ORF native
                                   (SEQ ID NO: 11)
>AAO13194.1 envelope glycoprotein GP3 PRRSV
MVNSCTFLHIFLCCSFLYSFCCAVVAGSNTTYCFWFPLVRGNFSFEL

TVNYTVCPPCLTRQAATEIYEPGRSLWCRIGYDRCGEDDHDELGFMI

PPGLSSEGHLTSVYAWLAFLSFSYTAQFHPEIFGIGNVSRVYVDIKH

QLICAEHDGQNTTLPRHDNISAVFQTYYQHQVDGGNWFHLEWLRPFF

SSWLVLNVSWFLRRSPANHVSVRVLQILRPTPPQRQALLSSKTSVAL

GIATRPLRRFAKSLSAVRR
```

The nucleotide sequence encoding the native PRRSV ORF3 sequence shown above (SEQ ID NO: 11) will be modified to generate a variant antigenic sequence in which one or more of the native putative glycosylation sites (shown in italics in SEQ ID NO: 11, above) will be removed through N to D residue substitutions (underlined and bolded), as reflected in SEQ ID NO: 12,

```
PRRSV ORF3 edited native
                                   (SEQ ID NO: 12)
Edited envelope glycoprotein GP3 [PRRSV]
MVNSCTFLHIFLCCSFLYSFCCAVVAGSDTTYCFWFPLVRGDFSFE

LTVDYTVCPPCLTRQAATEIYEPGRSLWCRIGYDRCGEDDHDELGF

MIPPGLSSEGHLTSVYAWLAFLSFSYTAQFHPEIFGIGDVSRVYVD

IKHQLICAEHDGQDTTLPRHDDISAVFQTYYQHQVDGGNWFHLEWL

RPFFSSWLVLDVSWFLRRSPANHVSVRVLQILRPTPPQRQALLSSK

TSVALGIATRPLRRFAKSLSAVRR
```

A NS encoding a truncated version of SEQ ID NO:12 (limited to AAs 1-100 thereof) (SEQ ID NO: 13) will also be generated and inserted into either a gD1 seq 1:gD1 seq 2 construct or a non-gD construct, as shown below—

```
PRRSV ORF3 edited/truncated
                                   (SEQ ID NO: 13)
Truncated edited envelope glycoprotein GP3
sequence [PRRSV]
MVNSCTFLHIFLCCSFLYSFCCAVVAGSDTTYCFWFPLVRGDFSFE

LTVDYTVCPPCLTRQAATEIYEPGRSLWCRIGYDRCGEDDHDELGF

MIPPGLSS
```

As described in Example 1, these constructs can further be combined with sequences encoding either PD-L1, PD-1 extracellular binding domain, PD-L1 extracellular binding domain, or EAT-2.

It is expected that one or more of the constructs will result in a significant level of B cell and T cell response against PRRSV.

IV. Example 3—ASFV CRA Screening

This Example provides an overview of a screening method to identify clinically relevant antigens (CRAs) in African Swine Fever Virus (ASFV), to incorporate nucleotide sequences encoding such CRAs into a gD:antigen fusion protein-encoding construct, such as a gD1 seq 1/gD1 seq 2 construct as described in Example 1, which is in turn incorporated into a suitable plasmid DNA vector delivery system and administered to pigs in a trial to assess the suitability of the CRAs in the context of a gDAgFP expression system.

Antigens that elicit CTL responses and are expressed during the early stage of ASFV infection will be identified, fused to a gD sequence and incorporated into a DNA vaccine. Because of ASF handling restrictions, the goal is achieved in several steps, beginning with identification of viral antigens that are present at very early stages of infection and that elicit a CTL response to vaccination of healthy pigs. Fusion of these viral antigens to gD sequences and expression optionally with a checkpoint inhibitor (e.g., a PD-L1 antagonist), especially in the context of a co-expressed innate adaptive immunity immunomodulator, such as EAT-2, will boost the adaptive response by enhancing viral antigen T cell recognition, T cell proliferation and T cell memory to elicit a rapid and effective T cell response at the earliest stages of ASFV primary infection upon viral entry into host cells.

Viral particles carry antigens that are introduced into infected cells early, even though expressed at the late, post-replication stage of viral infection. Therefore, late, immediate early, early and intermediate ORFs will be included in the screen. To stimulate an innate NK cell response to vaccination, a separate plasmid will be constructed that encodes an EAT-2 polypeptide to in turn enhance the adaptive processes of APC maturation, proliferation and T cell effector and memory responses to vaccine antigens. Pools of antigens will be formulated in a CaPNP delivery system, as described above. All plasmids will be amplified via an antibiotic resistance gene-free triclosan selection system.

Safety and immunogenicity of the designed CaPNP-formulated plasmid pool vaccine will be assessed in an animal trial: Pigs will receive a combined intranasal/intramuscular prime/boost vaccination at 4 and 6 weeks of age. On a weekly basis, blood will be collected to isolate and store serum and PBMC. Serum will be used in future neutralizing antibody studies. PBMC will be used to analyze the plasmid pool-induced systemic cellular immune response: Upon in vitro re-stimulation with the vaccine antigen pool, the proliferation, cytokine and perforin production, memory cell generation and homing pattern of CD4+ T cells, CTLs, TCR-γδ T cells, and NK cells by multi-color flow cytometry will be studied. At the day of the highest immune response, the response to the four individual antigen pools will be tested. Antigens presented as gD fusions are expected to generate robust CTL responses to all or almost all of the antigens in vaccinated pigs. Including NK cell biomarkers in the analysis is intended to measure effects of innate immune stimulation by the EAT-2-expressing second, co-administered DNA plasmid. This will be the first comprehensive flow cytometry evaluation of the T- and NK cell response to such a combination of a gD:antigen fusion protein and innate adaptive immunity immunomodulator.

Genomes of more than 39 strains of ASFV have been sequenced and are available at GenBank. Based on published work and database analyses, all early and immediate early genes independent of their biological function and intermediate and late genes critical for replication and spread will be identified. It is expected that at least 50-60 highly conserved genes will be selected based on what is known about ASFV biology. Amino acid sequences for each gene selected for vaccination will be aligned and compared among all strains for which sequences are available. This will allow identifying amino acid substitutions, if any, that are naturally occurring and whether regions or domains where variation is observed have any potential T cell epitopes. If significant variation is observed for a given gene, a sequence that is most likely to yield a T-cell response will be selected. Established gene synthesis and molecular biology techniques are readily available in laboratory manuals, on the internet, and from vendors (PCR, gene synthesis, restriction digestion, agarose electrophoresis, ligation, E. coli transformation, selection of resistant colonies, miniprep DNA preparations, sequencing with primers, and megaprep DNA preparation) and commercially available reagents (enzymes, reagents, kits for cloning and DNA preparations from NEB, ThermoFisher, IDT, and Qiagen). Full-length nucleotide sequences of selected genes (Genescript) and clone into plasmid vector pMBF116 or a similar vector containing sequences for a CMV IE promoter-CMV Intron A-gD-expressing sequences for gD1 seq 1 (or a variant thereof with reduced HVEM binding as described above) and/or gD1 seq 2—and suitable reporter elements/tags (e.g., an epitope tag, a GFP reporter gene, or both) will be synthesized. The plasmid also carries the Fab1 gene for triclosan non-antibiotic selection and plasmid amplification. The ASFV genes will have 11 amino acids of HSV epitope tag (QPELAPEDPED (SEQ ID NO: 119)) at the C-terminus. Optional additional features such as a 2A cleavage site, a ubiquitin PTPS-encoding sequence, or both can also be added to the construct in this or later iterations of the experiment.

All plasmids made will be confirmed by DNA sequencing (Functional Biosciences, Madison, Wis., USA). Endotoxin-free DNA preparations will then be made (Qiagen EndoFree Plasmid Kit). Optionally, In-Cell Western Assay is also or alternatively used to confirm protein expression in which cells in 96-well plates are transfected, fixed to the plate and immunostained with a fluorescently tagged antibody (epitope tag) and scanned with an automated fluorescence microscope.

Equal amounts of at least 50-60 plasmids will be pooled (25 pg/plasmid) and formulated with CaPNP (Southwest Research Institute, San Antonio Tex.) in PBS. DNA loading will be precisely quantified. For some experimental groups, the pool will be further mixed with 25 pg an EAT-2-expressing plasmid before formulation.

Vaccine safety and immunogenicity of the designed vaccine will be evaluated in a 42 day, optionally 56-day, animal trial. After a three-day acclimatization phase, pigs will receive a combination of an intranasal/intramuscular (IN/IM) prime (day 0) and boost vaccination (day 14) with the selected pools of plasmid constructs (e.g., ASFV putative antigen only, gD seq 1+ASFV putative CRA, or EAT-2+gD: ASFV putative CRA fusion protein). At study termination, pigs will be sacrificed and tracheobronchial lymph nodes collected for assessing the lung-regional immune response. Safety will be assessed by clinical monitoring; immunogenicity will be evaluated by weekly blood collections for isolation and storage of serum and PBMC. Sera will be used for neutralizing antibody analyses. PBMC will be used for in vitro restimulation assays to determine the vaccine-induced NK- and T-cell IR(s).

The following groups can be included in the study: Group A will receive a MOCK vaccination (unformulated CaPNP only (4 pigs)); group B will receive EAT-2-expressing plasmid only (4 pigs); group C will be administered gDAgFPES plasmids including AgES(s) from the synthetic gene library (8 pigs, 25 pg per plasmid); and group D will receive both, the synthetic library gDFP-expressing plasmid & EAT-2-expressing plasmid (8 pigs, 25 pg per plasmid).

To determine the T-cell response to the plasmid pool-encoded antigens, PBMC and lymphocytes isolated from tracheobronchial lymph nodes will be in vitro restimulated with a peptide pool representing the antigens used for vaccination. Activation/proliferation, cytotoxicity, cytokine production, differentiation, and homing pattern of T-cell subsets will be analyzed via multi-color flow cytometry. Activation/proliferation will be assessed by staining the cells with a proliferation dye (CellTrace™ Violet Cell Proliferation Kit, ThermoFisher, Waltham, Mass.) prior to a four-day cultivation period. Cytokine production will be determined using cytokine-specific antibodies (IFN-γ, TNF-α, and/or IL-2) after a 24-hour stimulation including a Golgi-inhibitor for the last four hours of culture to ensure cytokine accumulation within the cells. NK-cell and CTL cytotoxicity will be assessed by a CD107 degranulation assay following the procedures described by Mair et al. 2013. Proliferation, cytotoxicity, and cytokine stainings will be combined with antibody stainings against markers to distinguish different T-cell subsets (CD3, CD4, CD8α, TCR-γδ) as well as their differentiation status (CD45) and homing pattern (CCR7).

Only healthy piglets will be enrolled. Piglets will be randomly assigned to groups using the GraphPad online randomizer tool. Studies are planned with appropriate controls; and results will be analyzed via valid and appropriate statistical methodologies. The animal trial will be performed under BSL-2 conditions with approved Biological Use Authorizations and IACUC approval. The parameters to be measured to reflect effect of the treatments encompass different aspects of safety and immunogenicity. All in vitro studies will be performed in a BSL-2 certified laboratory. Scientific and experimental rigor are maintained in the laboratory. In vitro protocols are well established.

Data will be analyzed for normal distribution by Kolmogorov-Smirnov analysis. Non-normally distributed data will be analyzed by Mann-Whitney test. Normally distributed data will be analyzed using a repeated-measures 2-way ANOVA with time and vaccination as the 2 factors. Necropsy data will be analyzed by 2-way ANOVA with in vitro re-stimulation and vaccination as the 2 factors. Post hoc multiple comparisons will use the Dunnett's test. Differences will be defined significant (*) for $P<0.05$.

It is anticipated that the designed vaccine, especially in the context of EAT-2 co-expression, will induce a profound NK and T-cell response, especially in CTLs. This response will be a combination of proliferation, cytotoxicity, cytokine production and the development of tissue-homing memory cells (T effector memory cells, TEM).

PBMC isolated during the proposed study can further be used for a phase 2 leg of this project. Phase 2 will determine: i) the individual antigens or epitopes (e.g., a particular protein or epitope) within larger antigen units (e.g., an ORF or a large fragment of an ORF) that generated the detected immune responses; ii) confirmation of the immunogenicity of these antigens by in vitro re-stimulation with ASFV-infected cells; iii) the effects of gD and EAT-2 targeting/enhancement components of the system; iv) generated serum neutralizing antibody levels; and v) a challenge study using a combination of individual antigens that elicited a CTL and/or NK cells response.

V. Example 4—ASFV Plasmid Expression Vector

This Example demonstrates configurations of DNA plasmid vectors encoding ASFV antigens that can be used in trials such as those described in Example 3, and, if proven efficacious, for vaccination or treatment applications.

Plasmids are constructed to contain unique BamHI and NheI restriction enzyme sites before a human polyubiquitin sequence (e.g., SEQ ID NO: 1) and a NotI site after the ubiquitin-encoding sequence. An ASFV CP204L-encoding sequence (encoding an ASFV p30 protein) is inserted after the NotI site followed by 2A peptide cleavage sequence. A GFP reporter gene-encoding sequence is also incorporated, followed by unique restriction enzyme sites XhoI, PmeI, EcoRI, and ApaI.

The incorporation of multiple internal restriction sites and 3' sites provides the plasmid vector with the ability to incorporate genes in a variety of locations. For example, by use of select sites, cloning without fusion can be performed (clone at BamHI/NheI to XhoI/PmeI/EcoRI/ApaI).; cloning to result in an N-terminal Ubiquitin fusion and no GFP (clone at NotI to XhoI/PmeI/EcoRI/ApaI) can be performed; cloning to obtain a C-terminal cleavable GFP fusion (clone at BamHI/NheI to AgeI) can be performed; cloning to achieve an N-terminal Ubiquitin and C-terminal GFP fusion (clone at NotI to AgeI) can be performed; and/or cloning to replace GFP with any other marker (clone at AgeI to XhoI/PmeI/EcoRI/ApaI) can be performed.

The plasmid can be tested in experiments such as those described in Example 3 or other experiments in cell lines and pigs by detecting CP204L and GFP protein expression, B-cell response, T-cell response by western blotting, ELISpot, or flow cytometry, with suitable negative controls. In one variation, the CVM IE promoter is replaced with or also contains a CAG promoter. Plasmid expression in swine can be subjected to testing prior to larger scale trials by performing small-scale (e.g., 1-3 pig trials), each pig inoculated with endotoxin-free prepped plasmids as described above under different test conditions (e.g., with CMV or CAG promoters). Examples of a sequence overview of key elements of such plasmid constructs include (1) pMBF116-CMVp-Ub-CP204L-T2A-GFP-TcnR sequence (6153 bp (SEQ ID NO: 2)) (the DNA subsequence encoding ASFV CP204L antigen, GenBank Access No. YP_009704045.1 (encoding SEQ ID NO: 23), starting at nt 1905, is the first subsequence in ALL CAPS; the $2^{nd}$ ALL CAPS subsequence is a GFP sequence and the $3^{rd}$ long ALL CAPS sequence is a plasmid backbone sequence)—

(SEQ ID NO: 2)
cctgcaggtcgacaatattggctattggccattgcatacgttgtatctatatcataatatgtacatttata ttggctcatgtccaatatgaccgccatgttgacattgattattgactagttattaatagtaatcaattacg gggtcattagttcatagcccatatatggagttccgcgttacataacttacggtaaatggcccgcctggctg accgcccaacgaccccgcccattgacgtcaataatgacgtatgttcccatagtaacgccaatagggactt tccattgacgtcaatgggtggagtatttacggtaaactgcccacttggcagtacatcaagtgtatcatatg -continued ccaagtccgcccccctattgacgtcaatgacggtaaatggcccgcctggcattatgcccagtacatgacctt acgggactttcctacttggcagtacatctacgtattagtcatcgctattaccatggtgatgcggttttggc agtacaccaatgggcgtggatagcggtttgactcacggggatttccaagtctccacccccattgacgtcaat gggagtttgttttggcaccaaaatcaacgggactttccaaaatgtcgtaataaccccgcccccgttgacgca aatgggcggtaggcgtgtacggtgggaggtctatataagcagagctcgtttagtgaaccgtcagatcgcct ggagacgccatccacgctgttttgacctccatagaagacaccgggaccgatccagcctccgcggccgggaa cggtgcattggaacgcggattccccgtgccaagagtgacgtaagtaccgcctatagactctataggcacac ccctttggctcttatgcatgctatactgttttttggcttggggcctatacaccccgcttccttatgctata ggtgatggtatagcttagcctataggtgtgggttattgaccattattgaccactccctattggtgacgat actttccattactaatccataacatggctctttgccacaactatctctattggctatatgccaatactctg tccttcagagactgacacggactctgtattttacaggatggggtcccatttattatttacaaattcacat atacaacaacgccgtcccccgtgcccgcagttttattaaacatagcgtgggatctccacgcgaatctcgg gtacgtgttccggacatgggctcttctccggtagcggcggagcttccacatccgagccctggtcccatgcc tccagcggctcatggtcgctcggcagctccttgctcctaacagtggaggccagacttaggcacagcacaat gcccaccaccaccagtgtgccgcacaaggccgtggcggtagggtatgtgtctgaaaatgagctcggagatt gggctcgcaccgctgacgcagatggaagacttaaggcagcggcagaagaagatgcaggcagctgagttgtt gtattctgataagagtcagaggtaactcccgttgcggtgctgttaacggtggagggcagtgtagtctgagc agtactcgttgctgccgcgcgcgccaccagacataatagctgacagactaacagactgttcctttccatgg gtcttttctgcagtcaccgtccaagcttggatccGCTAGCgccaccATGcagatcttcgtgaagaccctga ccggcaagaccatcaccctggaggtggagcccagtgacaccatcgagaatgtgaaggccaagatccaggat aaggagggcattccccccgaccagcagaggctcatctttgcaggcaagcagctggaggatggccgcactct ttctgattacaacatccagaaagagtccaccctccatctggttctgcgtctgaggggtGCGGCCGCAGATT

TTATTTTAAATATATCCATGAAAATGGAGGTCATCTTCAAAACGGATTTAAGATCATCTTCACAAGTTGTG

TTTCATGCGGGTAGCCTGTATAATTGGTTTTCTGTTGAGATTATCAATAGCGGTAGAATTGTTACGACCGC

TATAAAAACATTGCTTAGTACTGTTAAGTATGATATTGTGAAATCTGCTCGTATATATGCAGGGCAAGGGT

ATACTGAACATCAGGCTCAAGAAGAATGGAATATGATTCTGCATGTGCTGTTTGAAGAGGAGACGGAATCC

TCAGCATCTTCGGAGAACATTCATGAAAAAAATGATAATGAAACCAATGAATGCACATCCTCCTTTGAAAC

GTTGTTTGAGCAAGAGCCCTCATCGGAGGTACCTAAAGACTCCAAGCTGTATATGCTTGCACAAAAGACTG

TGCAACATATTGAACAATATGGAAAGGCACCTGATTTTAACAAGGTTATTAGAGCACATAATTTTATTCAA

ACCATTTATGGAACCCCTCTAAAGGAAGAAGAAAAAGAGGTGGTAAGACTCATGGTTATTAAACTTTTAAA

AAAAATAAGCTATCTCACCTACATTaccggttccggcgagggcaggggaagtcttctaacatgcggggacg tggaggaaaatcccggcccaGTGAGCAAGGGCGAGGAGCTGTTCACCGGGGTGGTGCCCATCCTGGTCGAG

CTGGACGGCGACGTAAACGGCCACAAGTTCAGCGTGTCCGGCGAGGGCGAGGGCGATGCCACCTACGGCAA

GCTGACCCTGAAGTTCATCTGCACCACCGGCAAGCTGCCCGTGCCCTGGCCCACCCTCGTGACCACCCTGA

CCTACGGCGTGCAGTGCTTCAGCCGCTACCCCGACCACATGAAGCAGCACGACTTCTTCAAGTCCGCCATG

CCCGAAGGCTACGTCCAGGAGCGCACCATCTTCTTCAAGGACGACGGCAACTACAAGACCCGCGCCGAGGT

GAAGTTCGAGGGCGACACCCTGGTGAACCGCATCGAGCTGAAGGGCATCGACTTCAAGGAGGACGGCAACA

TCCTGGGGCACAAGCTGGAGTACAACTACAACAGCCACAACGTCTATATCATGGCCGACAAGCAGAAGAAC

GGCATCAAGGTGAACTTCAAGATCCGCCACAACATCGAGGACGGCAGCGTGCAGCTCGCCGACCACTACCA

GCAGAACACCCCCATCGGCGACGGCCCCGTGCTGCTGCCCGACAACCACTACCTGAGCACCCAGTCCGCCC

TGAGCAAAGACCCCAACGAGAAGCGCGATCACATGGTCCTGCTGGAGTTCGTGACCGCCGCCGGGATCACT

-continued

CTCGGCATGGACGAGCTGTACAAGTAActcgagGTTTAAACgaattctgcagatatccagcacagtggtcg aggggcccggagatctacgtatgatcagcctcgactgtgccttctagttgccagccatctgttgtttgccc ctcccccgtgccttccttgaccctggaaggtgccactcccactgtcctttcctaataaaatgaggaaattg catcgcattgtctgagtaggtgtcattctattctgggggtggggtggggcaggacagcaaggggaggat tgggaagacaatagcaggcatgctggggatgcggtgggctctatggcttctgaggcggaaagaaccagctg gggctcgacagctcgactctagaattgcttcctcgctcactgactcgctgcgctcggtcgttcggctgcgg cgagcggtatcagctcactcaaaggcggtaatacggttatccacagaatcagggataacgcaggaaagaa catgtgagcaaaaggccagcaaaaggccaggaaccgtaaaaaggccgcgttgctggcgtttttccataggc tccgcccccctgacgagcatcacaaaaatcgacgctcaagtcagaggtggcgaaacccgacaggactataa agataccaggcgtttccccctggaagctccctcgtgcgctctcctgttccgaccctgccgcttaccggata cctgtccgcctttctcccttcgggaagcgtggcgctttctcatagctcacgctgtaggtatctcagttcgg tgtaggtcgttcgctccaagctgggctgtgtgcacgaaccccccgttcagcccgaccgctgcgccttatcc ggtaactatcgtcttgagtccaacccggtaagacacgacttatcgccactggcagcagccactggtaacag gattagcagagcgaggtatgtaggcggtgctacagagttcttgaagtggtggcctaactacggctacacta gaagaacagtatttggtatctgcgctctgctgaagccagttaccttcggaaaaagagttggtagctcttga tccggcaaacaaaccaccgctggtagcggtggtttttttgtttgcaagcagcagattacgcgcagaaaaaa aggatctcaagaagatcctttgatcttttctacggggtctgacgctcagtggaacgaaaactcacgttaag ggattttggtcatgagattatcaaaaaggatcttcacctagatccttttaaattaaaaatgaagttttaaa tcaatctaaagtatatatgagtaaacttggtctgacagttaccaatgcttaatcagtgaggcacctatctc agcgatctgtctatttcgttcatccatagttgcctgactcggggggggggggcgctgaggtctgcctcgtg aagaaggtgttgctgactcataccaggcctgaatcgccccatcatccagccagaaagtgagggagccacgg ttgatgagagctttgttgtaggtggaccagttggtgattttgaacttttgctttgccacggaacggtctgc gttgtcgggaagatgcgtgatctgatccttcaactcagcaaaagttcgatttattcaacaaagccgccgtc ccgtcaagtcagcgtaatgctctgccagtgttacaaccaattaaccaattctgaTTAATTAAttatttcag ttcgagttcgttcattgcagcaatgctgaaaccgccgtcaacgtggaccacttcaccggagataccggcag agagatcggagcacaggaatgccgcagagttacccacatcttcaatagtaacggtacggcgaatcggggta acggcttcgcaatgagccagcattttgcggaagtctttgataccggaggccgccagagtacggatcggacc agcagagatggcgttaacacgcacaccttccggacccatcgcgttcgccatatagcgcacgttcgcttcca gagacgcttttgccagacccataacgttgtagttcgggatagcgcgctcagcgccaaggtaggaaagggtc agcagggcagaacccggattcagcatggagcggcaagcttttgccattgcaacgaagctgtaggagctgat gtcgtgggcaattttgaagccttcacgggtaacggcgttaacatagtcaccatccagctgatcgccaggtg caaaaccaatagagtgtacgaaaccgtcaaatttcggccaaactttccccagttcagcgaacatggtgtcg atgctggcatcttctgcaacatcgcactgcagaacgatgtcagaacccaattgagcggcaaattcttctac gcggcctttcagtttgtcgttctggtaggtgaatgccagttcagctccttcgcggtgcatcgcctgagcga taccgtaggcgatggatagtttgctggcaacGccggttaccagaatgcgcttaccggaaagaaaacccatA

GCTTTAATCCTTATTGTTGATGCTTGTTGTGCCTGAAAATCAGGCGATTCGTCGAGTAAACAGTACGAACA

GATAAACGGTTATTATAATCAACCTGGCTGTGAGTAGCTATAGTTGCCAGGTCCGACCGGAGCAGGCTGCG

GCAGGGGGGCGCTTTTCCCCTCACCCTAACCCTCTCCCCAGAGGGGCGAGGGGACCGTATTGTGCAAATA

-continued

```
TTGTTACCCCAGCAACAAACAGGCTCATACAGCCCCTAACCCTTTCATGGCGATGGCTGGGACGGTTCAGA

CCTTGCCGAATATTCTCCAGCACaatattattgaagcatttatcagggttattgtcGGCGCGCCtcagaga ttttgagacacaacgtggctttccccccccccccggcatg
``` and (2) pMBF117-CMVp-Ub-CP204L-T2A-GFP-TcnR sequence: 6223 bp (SEQ ID NO: 3) (the 1st subsequence marked in ALL CAPS is a plasmid backbone sequence; a subsequence encoding ASFV CP204L antigen, GenBank Accession No. YP_009704045.1 (encoding SEQ ID NO: 23), starts at nt 1905 as the second subsequence marked in ALL CAPS; and the third long sequence marked in ALL CAPS is a GFP sequence; finally, the fourth long DNA subsequence noted in ALL CAPS is a different plasmid backbone sequence)—

```
                                                                (SEQ ID NO: 3)
cctgcaggtcgacATTGATTATTGACTAGTTATTAATAGTAATCAATTACGGGGTCATTAGTTCATAGCCC

ATATATGGAGTTCCGCGTTACATAACTTACGGTAAATGGCCCGCCTGGCTGACCGCCCAACGACCCCCGCC

CATTGACGTCAATAATGACGTATGTTCCCATAGTAACGCCAATAGGGACTTTCCATTGACGTCAATGGGTG

GACTATTTACGGTAAACTGCCCACTTGGCAGTACATCAAGTGTATCATATGCCAAGTACGCCCCCTATTGA

CGTCAATGACGGTAAATGGCCCGCCTGGCATTATGCCCAGTACATGACCTTATGGGACTTTCCTACTTGGC

AGTACATCTACGTATTAGTCATCGCTATTACCATGGTCGAGGTGAGCCCCACGTTCTGCTTCACTCTCCC

CATCTCCCCCCCCTCCCCACCCCCAATTTTTGTATTTATTTATTTTTTAATTATTTTGTGCAGCGATGGGG

GCGGGGGGGGGGGGGCGCGCGCCAGGCGGGGCGGGGCGGGGCGAGGGGCGGGGCGGGGCGAGGCGGAGAG

GTGCGGCGGCAGCCAATCAGAGCGGCGCGCTCCGAAAGTTTCCTTTTATGGCGAGGCGGCGGCGGCGGCGG

CCCTATAAAAAGCGAAGCGCGCGGCGGGCGGGAGTCGCTGCGTTGCCTTCGCCCCGTGCCCCGCTCCGCGC

CGCCTCGCGCCGCCCGCCCCGGCTCTGACTGACCGCGTTACTCCCACAGGTGAGCGGGCGGGACGGCCCTT

CTCCTCCGGGCTGTAATTAGCGCTTGGTTTAATGACGGCTCGTTTCTTTTCTGTGGCTGCGTGAAAGCCTT

AAAGGGCTCCGGGAGGGCCCTTTGTGCGGGGGGGAGCGGCTCGGGGGGTGCGTGCGTGTGTGTGCGTGG

GGAGCGCCGCGTGCGGCCCGCGCTGCCCGGCGGCTGTGAGCGCTGCGGGCGCGGCGCGGGGCTTTGTGCGC

TCCGCGTGTGCGCGAGGGGAGCGCGGCCGGGGCGGTGCCCCGCGGTGCGGGGGGGCTGCGAGGGGAACAA

AGGCTGCGTGCGGGGTGTGTGCGTGGGGGGGTGAGCAGGGGGTGTGGGCGCGGCGGTCGGGCTGTAACCCC

CCCCTGCACCCCCCTCCCCGAGTTGCTGAGCACGGCCCGGCTTCGGGTGCGGGGCTCCGTGCGGGGCGTGG

CGCGGGGCTCGCCGTGCCGGGCGGGGGTGGCGGCAGGTGGGGGTGCCGGGCGGGGCGGGGCCGCCTCGGG

CCGGGGAGGGCTCGGGGGAGGGGCGCGGCGGCCCCGGAGCGCCGGCGGCTGTCGAGGCGCGGCGAGCCGCA

GCCATTGCCTTTTATGGTAATCGTGCGAGAGGGCGCAGGGACTTCCTTTGTCCCAAATCTGGCGGAGCCGA

AATCTGGGAGGCGCCGCCGCACCCCCTCTAGCGGGCGCGGGCGAAGCGGTGCGGCGCCGGCAGGAAGGAAA

TGGGCGGGGAGGGCCTTCGTGCGTCGCCGCGCCGCCGTCCCCTTCTCCATCTCCAGCCTCGGGGCTGCCGC

AGGGGGACGGCTGCCTTCGGGGGGGACGGGGCAGGGCGGGGTTCGGCTTCTGGCGTGTGACCGGCGGCTCT

AGAGCCTCTGCTAACCATGTTCATGCCTTCTTCTTTTTCCTACAGCTCCTGGGCAACGTGCTGGTTATTGT

GCTGTCTCATCTTTTGGCAAAaagcttggatccGCTAGCgccaccATGcagatcttcgtgaagaccctgac cggcaagaccatcaccctggaggtggagcccagtgacaccatcgagaatgtgaaggccaagatccaggata aggagggcattccccccgaccagcagaggctcatctttgcaggcaagcagctggaggatggccgcactctt tctgattacaacatccagaaagagtccaccctccatctggttctgcgtctgaggggtGCGGCCGCAGATTT

TATTTTAAATATATCCATGAAAATGGAGGTCATCTTCAAAACGGATTTAAGATCATCTTCACAAGTTGTGT

TTCATGCGGGTAGCCTGTATAATTGGTTTTCTGTTGAGATTATCAATAGCGGTAGAATTGTTACGACCGCT

ATAAAAACATTGCTTAGTACTGTTAAGTATGATATTGTGAAATCTGCTCGTATATATGCAGGGCAAGGGTA

TACTGAACATCAGGCTCAAGAAGAATGGAATATGATTCTGCATGTGCTGTTTGAAGAGGAGACGGAATCCT

CAGCATCTTCGGAGAACATTCATGAAAAAAATGATAATGAAACCAATGAATGCACATCCTCCTTTGAAACG
```

-continued

```
TTGTTTGAGCAAGAGCCCTCATCGGAGGTACCTAAAGACTCCAAGCTGTATATGCTTGCACAAAAGACTGT
GCAACATATTGAACAATATGGAAAGGCACCTGATTTTAACAAGGTTATTAGAGCACATAATTTTATTCAA
CCATTTATGGAACCCCTCTAAAGGAAGAAGAAAAAGAGGTGGTAAGACTCATGGTTATTAAACTTTTAAAA
AAAATAAGCTTTTATCTCACCTACATTaccggttccggcgagggcagggGaagtcttctaacatgcgggga
cgtggaggaaaatcccggcccaGTGAGCAAGGGCGAGGAGCTGTTCACCGGGGTGGTGCCCATCCTGGTCG
AGCTGGACGGCGACGTAAACGGCCACAAGTTCAGCGTGTCCGGCGAGGGCGAGGGCGATGCCACCTACGGC
AAGCTGACCCTGAAGTTCATCTGCACCACCGGCAAGCTGCCCGTGCCCTGGCCCACCCTCGTGACCACCCT
GACCTACGGCGTGCAGTGCTTCAGCCGCTACCCCGACCACATGAAGCAGCACGACTTCTTCAAGTCCGCCA
TGCCCGAAGGCTACGTCCAGGAGCGCACCATCTTCTTCAAGGACGACGGCAACTACAAGACCCGCGCCGAG
GTGAAGTTCGAGGGCGACACCCTGGTGAACCGCATCGAGCTGAAGGGCATCGACTTCAAGGAGGACGGCAA
CATCCTGGGGCACAAGCTGGAGTACAACTACAACAGCCACAACGTCTATATCATGGCCGACAAGCAGAAGA
ACGGCATCAAGGTGAACTTCAAGATCCGCCACAACATCGAGGACGGCAGCGTGCAGCTCGCCGACCACTAC
CAGCAGAACACCCCCATCGGCGACGGCCCCGTGCTGCTGCCCGACAACCACTACCTGAGCACCCAGTCCGC
CCTGAGCAAAGACCCCAACGAGAAGCGCGATCACATGGTCCTGCTGGAGTTCGTGACCGCCGCCGGGATCA
CTCTCGGCATGGACGAGCTGTACAAGTAActcgagGTTTAAACgaattctgcagatatccagcacagtggt
cgaggggcccgagatctacgtatgatcagcctcgactgtgccttctagttgccagccatctgttgtttgc
ccctcccccgtgccttccttgaccctggaaggtgccactcccactgtcctttcctaataaaatgaggaaat
tgcatcgcattgtctgagtaggtgtcattctattctgggggGtggggtggggcaggacagcaaggggggagg
attgggaagacaatagcaggcatgctggggatgcggtgggctctatggcttctgaggcggaaagaaccagc
tggggctcgacagctcgactctagaattgcttcctcgctcactgactcgctgcgctcggtcgttcggctgc
ggcgagcggtatcagctcactcaaaggcggtaatacggttatccacagaatcaggggataacgcaggaaag
aacatgtgagcaaaaggccagcaaaaggccaggaaccgtaaaaaggccgcgttgctggcgtttttccatag
gctccgcccccctgacgagcatcacaaaaatcgacgctcaagtcagaggtggcgaaacccgacaggactat
aaagataccaggcgtttccccctggaagctccctcgtgcgctctcctgttccgaccctgccgcttaccgga
tacctgtccgcctttctcccttcgggaagcgtggcgctttctcatagctcacgctgtaggtatctcagttc
ggtgtaggtcgttcgctccaagctgggctgtgtgcacgaaccccccgttcagcccgaccgctgcgccttat
ccggtaactatcgtcttgagtccaacccggtaagacacgacttatcgccactggcagcagccactggtaac
aggattagcagagcgaggtatgtaggcggtgctacagagttcttgaagtggtggcctaactacggctacac
tagaagaacagtatttggtatctgcgctctgctgaagccagttaccttcggaaaaagagttggtagctctt
gatccggcaaacaaaccaccgctggtagcggtggtttttttgtttgcaagcagcagattacgcgcagaaaa
aaaggatctcaagaagatcctttgatcttttctacggggtctgacgctcagtggaacgaaaactcacgtta
agggattttggtcatgagattatcaaaaaggatcttcacctagatccttttaaattaaaaatgaagtttta
aatcaatctaaagtatatatgagtaaacttggtctgacagttaccaatgcttaatcagtgaggcacctatc
tcagcgatctgtctatttcgttcatccatagttgcctgactcgggggggggggcgctgaggtctgcctcg
tgaagaaggtgttgctgactcataccaggcctgaatcgccccatcatccagccagaaagtgagggagccac
ggttgatgagagctttgttgtaggtggaccagttggtgattttgaacttttgctttgccacggaacggtct
gcgttgtcgggaagatgcgtgatctgatccttcaactcagcaaaagttcgatttattcaacaaagccgccg
tcccgtcaagtcagcgtaatgctctgccagtgttacaaccaattaaccaattctgaTTAATTAAttatttc
agttcgagttcgttcattgcagcaatgctgaaaccgccgtcaacgtggaccacttcaccggagataccggc
agagagatcggagcacaggaatgccgcagagttacccacatcttcaatagtaacggtacggcgaatcgggg
```

-continued
```
taacggcttcgcaatgagccagcattttgcggaagtctttgataccggaggccgccagagtacggatcgga ccagcagagatggcgttaacacgcacaccttccggacccatcgcgttcgccatatagcgcacgttcgcttc cagagacgcttttgccagacccataacgttgtagttcgggatagcgcgctcagcgccaaggtaggaaaggg tcagcagggcagaacccggattcagcatggagcggcaagcttttgccattgcaacgaagctgtaggagctg atgtcgtgggcaattttgaagccttcacgggtaacggcgttaacatagtcaccatccagctgatcgccagg tgcaaaaccaatagagtgtacgaaaccgtcaaatttcggccaaactttccccagttcagcgaacatggtgt cgatgctggcatcttctgcaacatcgcactgcagaacgatgtcagaacccaattgagcggcaaattcttct acgcggcctttcagtttgtcgttctggtaggtgaatgccagttcagctccttcgcggtgcatcgcctgagc gataccgtaggcgatggatagtttgctggcaacGccggttaccagaatgcgcttaccggaaagaaaaccca tAGCTTTAATCCTTATTGTTGATGCTTGTTGTGCCTGAAAATCAGGCGATTCGTCGTTTTAGTAAACAGTA

CGAACAGATAAACGGTTATTATAATCAACCTGGCTGTGAGTAGCTATAGTTGCCAGGTCCGACCGGAGCAG

GCTGCGGCAGGGGGGGCGCTTTTCCCCTCACCCTAACCCTCTCCCCAGAGGGGCGAGGGGACCGTATTGTG

CAAATATTGTTACCCCAGCAACAAACAGGCTCATACAGCCCCTAACCCTTTCATGGCGATGGCTGGGACGG

TTCAGACCTTGCCGAATATTCTCCAGCACaatattattgaagcatttatcagggttattgtcGGCGCGCCt cagagattttgagacacaacgtggctttcccccccccccccggcatg.
```

It is expected that such plasmid vectors will result in a robust immune response in pigs and will be useful as or in generating constructs that are protective against ASFV when utilized in association with the principles described in the present disclosure.

VI. Example 5—Canine Bladder Cancer

This Example demonstrates an approach to generating constructs for testing and demonstrating how constructs and compositions generated according to the principles and techniques provided in this disclosure can be used to demonstrate efficacy against canine bladder cancer in a clinical trial. The study comprises vaccine design, testing the vaccine for safety and immunogenicity in healthy dogs, and a clinical safety and efficacy study in dogs with naturally occurring bladder cancer. Diagnostic tests will be used to classify T cell tumor type in each patient to correlate efficacy of the vaccine combination therapy with T cell inflamed and the more difficult-to-treat T cell non inflamed tumors. A successful outcome of this study will be an immunotherapeutic checkpoint inhibitor vaccine whose efficacy can be correlated with tumor classification and response to treatment. Phase 2 will be the design and conduct of a pivotal safety and efficacy study in dogs.

Sequences encoding one or more, typically five (5) or more (e.g., eight or more, ten or more, or even twelve or more, such as 13 antigens as exemplified below) anti-tumor antigens known to be T cell targets in bladder cancer are obtained and fused with sequences encoding gD1 seq 1 and gD1 seq 2 to generate a gD:antigen fusion protein-encoding construct. The different antigen sequences can optionally be separated by linker sequences (e.g., any of the mid-sized linker sequences described in the Detailed Description or more simple linkers such as Ala-Ala linkers), cleavage sites, or both. Both DNA plasmid vectors and adenoviral vectors comprising the constructs can be generated for application such as gD:antigen fusion protein-encoding construct, such as a gD1 seq 1/gD1 seq 2 construct as described in Example 1, which is in turn incorporated into a suitable plasmid DNA vector delivery system and administered to dogs in a trial to assess the suitability of the CRAs in the context of a gD:antigen fusion protein expression system.

Alternatively, gD:antigen fusions can be cloned into adenovirus ("Ad") C68 vector derived from a chimpanzee and deleted for the E1 gene that is essential for virus replication, has no known virulence features associated with this adenovirus, and is not normally found in dogs, such that dogs are expected to not exhibit pre-existing immunity to such vectors. It will be understood that Ad vectors having similar properties (little pre-existing immunity, replication deficiency, etc.) could be used as an alternative in this type of application. As adenoviral vectors can sometimes exhibit adjuvant effects and efficient expression of constructs they can be used as an alternative to or plasmid DNA vectors in combination with plasmid DNA vectors. Plasmids generated in the study will also include "shuttle plasmids" used to incorporate constructs within Ad vectors. Antigen expression from the vectors will be assessed in human kidney HEK293 and dog thymus Cf2Th cells. Once expression is confirmed, recombinant Ad vectors can be purified using known techniques. As a further step, initial T cell immunogenicity of the AdC68 gDmulti-antigen-expressing vector can be confirmed in mouse studies as described in the Wistar Art. In some cases, EAT-2 sequence is added to the construct to enhance immunological response or a separate vector comprising an EAT-2-expressing sequence is co-administered. In some cases, a separate vector comprising a sequence encoding only FAP is also or alternatively administered. In some cases, a separate vector comprising a sequence encoding a CRACC protein, such as a CRACC-Fc protein (CRACC protein fused to the Fc domain of IgG) is also or alternatively administered. CRACC is an IAII that upregulates innate immunity-NK cell and DC that in turn strengthens the adaptive immune response to vaccine antigens (T and B cell) and that also exhibits checkpoint inhibition effects. Sequences for a PTPS, such as SEQ ID NO: 1 and EEI(s), such as a CMV Intron A sequence, also can be incorporated if desired, either in initial constructs or in subsequently tested constructs.

Five dogs for each treatment group will be provided. Plasmids will be administered subcutaneously at a dosage of 10 to 100 micrograms. In some cases, plasmids expressing a FAP antigen will be separately co-administered with the gD:antigen-expressing construct, typically at the same dosage and by the same route. In other cases, a plasmid comprising a sequence encoding a CRACC IAII sequence also or alternatively will be administered to a similar group of dogs. Thus, for example, groups can be administered the gD:polyTAA-expressing plasmid vector alone; the gD:poly-TAA vector+a FAP only-expressing plasmid, or a combination of all of the gD:polyTAA vector, the FAP only-expressing vector, and a CRACC-expressing vector. Other exemplary groups will include a combination of gD:poly-TAA Ad68+CRACC-Fc Ad68 (exhibiting a dual checkpoint inhibitor therapy—also referred to as a "doublet therapy"); gD:polyTAA Ad68+CRACC-Fc Ad68+FAP Ad68; or gD:polyTAA Ad68+FAP Ad68+ EAT-2 Ad68. In cases, priming, boosting, or both with CaPNP-associated plasmids comprising corresponding constructs is performed.

PBMCs will be collected at appropriate timepoints post vaccination. Intracellular cytokine staining of PBMCs by ELISpot assays and flow cytometry analysis for production of interferon-gamma in response to the tumor-specific antigens present in the vaccine constructs will be performed. When possible, biopsy samples will be categorized by tumor type by genome expression profiling with the objective of correlating outcome to T cell inflamed or T cell noninflamed TME. T-cell-inflamed and non-T-cell-inflamed bladder tumors can be distinguished by immune gene expression profiling. SFE Sweis R F, Spranger S, Bao R, et al. Molecular Drivers of the Non-T-cell-Inflamed Tumor Microenvironment in Urothelial Bladder Cancer. Cancer Immunol Res. 2016; 4(7):563-568, for relevant principles/methods and further methods provided in the Detailed Description.

From the results of these experiments, one or more constructs will be selected and advanced to scale up for pivotal studies in dogs.

VII. Example 6—Human Bladder Cancer

Coordinated transcriptional changes in canine and human bladder cancer, including gene functions, pathways, and cytogenetic regions were highly similar at functional and pathway levels (see, Ramsay 2017). A comparison study of canine vs human TCC gene expression patterns revealed >43,000 genes expressed by both species, 436 were unique to TCC and common to both species (Dhawan et al. 2015).

Upon successful completion of a pivotal study of one or more of the constructs described in Example 5, human clinical safety and then efficacy studies will be performed using the Ad68 or plasmid DNA constructs comprising the vaccine successfully demonstrated in the canine model. It is expected that similar efficacy will be demonstrated in humans given relevance of the canine model of bladder cancer to the human condition.

VIII. Example 7—Canine Influenza CRA Screening

This Example exemplifies use of the compositions and methods of the invention provided in this disclosure to provide an effective, innovative cross-protective vaccine for canine influenza (CIV). The objective of this effort is to develop a vaccine that is able to induce significant B cell and T cell responses to both H3N2 and H3N8 CIV. It is expected that effective treatment methods using constructs developed according to the methods in this Example (and generally in this disclosure) will result in a vaccine that elicits an effective immune response within seven to fourteen days of an initial (and possibly single/only) administration in terms of a significant reduction in viral shedding, reduction in viremia, and/or reduction in severity of CIV-related symptoms (e.g., cough, runny nose, fever, lethargy, eye discharge, and reduced appetite).

Expression Library Immunization studies will be conducted in vitro with infected cells and in healthy dogs. B and T cell responses to vaccine antigens in each of the pooled study groups will be evaluated and confirmed using ELISA, Flow Cytometry, and/or ELISpot. The results of this work will lead to the identification of clinically relevant antigens (CRAs) relevant to CIV. Nucleotide sequences encoding CRAs or variants of such CRAs (e.g., deglycosylation variants) will be generated and inserted into gD:antigen fusion protein constructs (e.g., gD1 seq 1 and gD1 seq 2 constructs, in which CIV CRA-encoding sequences will be inserted).

Also or alternatively a number of known CIV antigens can be used to generate putative gD:antigen fusion protein-encoding nucleic acid constructs. Candidate CIV antigens for use in such testing methods include: (a) Hemagglutinin A surface antigen or portions thereof (e.g., the conserved stalk—H3N2 HA stalk domain); (b) Ion channel protein M2 or portions thereof (e.g., domain M2 or domain M2e); (c) Nucleoprotein (NP); (d) M1 (matrix protein 1); (d) Neuraminidase (N1, N2); or (e) combinations of any/all thereof.

Also or alternatively, putative antigens expected to be associated with "unnatural immunity" (Scorza 2016; Nabel et al. 2010) (i.e., to induce antibody and cellular immunity to viral antigens that are not naturally or effectively recognized by the immune system but that can provide protection when presented to the immune system in a vaccine) are selected and related sequences incorporated into selected, suitable delivery systems.

Adenoviral vectors and/or DNA plasmids (associated with CaPNPs) will be generated comprising these sequences, EAT-2, and these gD:antigen fusion protein-encoding sequences plus EAT-2. These plasmids (and suitable control plasmids) will be first used in suitable safety/immunogenicity studies then in an immunization/challenge study in healthy dogs. An exemplary set of challenge study plasmid constructs could include: (a) Control; (b) hEAT-2; (c) hEAT-2+gD1 seq 1:CRA:gD1 seq 2; and (d) gD1 seq 1:CRA:gD1 seq 2.

A variety of CRAs are expected to be identified by ELI, such that the number of CRA-encoding constructs is likely to be ≥1 in instances.

AOA, known Ag(s) expected to be effective in the context of the expression constructs of the invention can be directly generated and similarly tested. Candidate CIV antigens that can be include in such test constructs can include: The CIV HA stalk domain (HA-SD); CIV NP; CIV M1; and CIV M2.

For example, adenoviral vectors and/or DNA plasmids expressing HA Stalk Domain (HA-SD) fused to one or more of NP, M1, and M2 proteins can be tested in the following combinations and analyzed for B and T cell responses: (1) AdC68-HA-SD/NP/M1/M2; (2) AdC68-gD-HA-SD/NP/M1/M2; (3) CaPNP-gD-HA-SD/NP/M1/M2; (4) gD-HA-SD/NP/M1/M2; and Nobivac® Canine Flu Bivalent Vaccine (as a control/comparator).

All plasmids will be confirmed by DNA sequencing before transfecting into HEK293 and Cf2Th cells. Expression of individual proteins will be confirmed by western blotting using commercially available antigen-specific monoclonal or polyclonal antibodies.

Adenovirus shuttle plasmid and DNA vaccine plasmids with multi-gene co-expression using 2A cleavage sequences can be generated and analysis of constructs for antigen expression performed using methods discussed above. Plasmids can be used for viral vector delivery and plasmids are suitable for DNA vaccination with nanoparticles at the same time because the cloning strategy is similar. In vitro studies and vaccination with plasmid DNA delivered in nanoparticles and in a replication-defective adenoviral vector can be formed to conduct direct comparison of immune responses to the two different delivery systems. Adenoviral vectored constructs with and without gD allow for evaluation of gD responses DNA sequencing before transfection of HEK293 and Cf2Th cells and detection of the transgene proteins by western blot analysis will confirm that all plasmids are suitable for virus vector preparation and incorporation into particles. gD fusion antigens will be separated by cleavable spacers so that some antigens will be released into the circulation for exposure to B cells. Antigen protein expression will be analyzed with Western blots. If antigens are not expressed or not properly cleaved, the positions of the NP, M1, and M2 genes in relation to each other will be reordered to optimize expression of all four proteins.

E1/E3 deleted simian adenovirus Adc68, HuAd5 or other adenoviral strain not endemic in dogs can be used for adenoviral vector delivery systems. The well-established procedure of homologous recombination to insert shuttle plasmids into the backbone adenoviral plasmid will be used. HEK293 cells expressing HAd5 E1 gene products will be used for generation of replication deficient Ad-CIV101 recombinant virus. The steps involved are: 1) transfect the shuttle plasmid into the 293A Cell Line to produce an adenoviral stock, 2) amplify the adenoviral stock on 10×T75 flasks, 3) purify the virus, 4) titer the virus, 5) use the amplified adenoviral stock to transduce HEK293 and Cf2Th cells and analyze by western bot of transient expression of antigens, and 6) use purified and expression-confirmed virus for mouse immunogenicity studies. DNA plasmids will be generated and formulated with CaPNP before testing (e.g., CaPNP-gD-HA-SD/M1/M2).

The safety and immunogenicity of each of the candidate vaccines and commercial standard(s) will be assessed by administration to healthy dogs (e.g., 5 dogs per group), receiving 10 to 100 micrograms of plasmid DNA via mucosal or subcutaneous administration of CaPNP-gD-HA-SD/NP/M1/M2 or naked DNA gD-HA-SD/NP/M1/M2, optionally in combination with an EAT-2 expressing sequence or nucleic acid. Nucleic acid compositions will be delivered by mucosal or subcutaneous administration and 1 mL Nobivac® Canine Flu Bivalent Vaccine (killed H3N2 & H3N8 virus plus alum adjuvant; a conventional vaccine reference used as a comparator) also will be administered per current product instructions.

Blood will be collected from treated animals before vaccination and at 24, 48 and 168 hours (7 days), 14 days, and 21 and 42 days. Assays performed after vaccination can include CBC, plasma chemistry: baseline and at 24, 48, and 168 hours (7 days). Health inspection by (a) veterinarian(s), including rectal temperature can be performed at baseline, 1, 3, 6, and 12 hours post-treatment; once daily thereafter; and clinical observations waived on days when a physical exam is conducted at Days 2 and 7.

PBMC sampling from each group of 5 dogs can be taken at baseline, and 7, 14, 21 and 42 days after vaccination. Blood volume taken will be 10-15 ml. Blood collection procedures for T cell assays are conducted as follows: For each bleed/each dog, use a 2 BD Vacutainer® CPT™ Mononuclear Cell Preparation Tube—Sodium Heparin (16×125 mm/8 mL) from BD Bioscience) to collect 10-15 ml blood and process according to manufacturers' instructions. Because there can be a circadian rhythm to some immune responses, blood samples are be collected at approximately the same hour each sampling day throughout the study.

B cell responses in dogs can be assessed through virus neutralization and ELISA. For example, antibodies to NP, M2, or H3 (polyclonal) can be purchased currently or it is possible to generate polyclonal antibodies, for example to HA stalk. Enzyme-linked immunosorbent assay (ELISA) can be performed for antibodies to CIV antigens using sera from vaccinated and naive mice/dogs on plates coated with purified CIV antigens.

Intracellular cytokine staining can be performed as briefly described here: PBMCs will be tested by ELISpot assays for production of interferon-gamma in response to the influenza antigen-specific peptides present in the vaccine. CIV antigen-specific CD8+ and CD4+ T cell analyses will be conducted on selected cryopreserved PBMCs. All samples from each dog will be analyzed in parallel. Cells will be stained with a live cell stain, antibodies to CD3, CD4 and CD8 and intracellular interferon-gamma and TNF-alpha. A goal of this experiment is to determine if frequencies of T cells to influenza-associated antigens increase after vaccination. It is expected that days 7-14 will show peak IRs, while week 6 responses are expected to represent steady state IRs.

The Phase I study will be followed by advancing one or more CIV antigen constructs to a Phase I challenge study in dogs. Through application of such methods, one or more candidates for pivotal trials and further development into approved treatments for CIV are expected to be developed.

IX. Example 8—EHV Treatment

This Example outlines the application of principles, compositions, and methods of this invention to develop candidate vaccines leading to an effective vaccine that elicits effective, long-lasting protective immunity to equine herpes virus (EHV). It is specifically expected that identified effective vaccines developed by such methods will make significant improvements in terms of EHV-related myeloencephalopathy and abortion rates and both prevent infection and reactivation from latency.

The EHV-1 genome consists of 80 ORFs (Paillot R. et al. 2008) that separate into four categories (Allen et al 2004):
1. nucleocapsid and tegument structural proteins;
2. transmembrane/envelope glycoproteins;
3. regulatory/transcription activation proteins;
4. DNA replication, viral packaging, morphogenesis, and egress proteins.

Putative CRAs can be identified by Expression Library Immunization (ELI) as discussed above and/or mass spectrometry (MS) using known methods. Alternatively, known EHV candidate antigens to be directly tested in methods similar to those described in the preceding Examples can include: (a) IE (ICP4, ORF 64 intermediate early) protein; (b) ORF-12 tegument protein a-TIF; (c) ICP0; (d) gB; (e) gD; (f) gH; (g) gL; (h) gK; (i) gC; (j) gE; (k) gG; (1) gI; (m) gM; (n) sp300; (o) gE/gI; (p) gM; (q) gp300 (gp2); (r) UL27 (gB); (s) UL29 (major DNA binding protein); (t) UL39 (ribonucleoside reductase R1); (u) ICP4 (IE protein); (v) ICP0 (ubiquitin E3 ligase); (w) ICP22 (intermediate early infectious cell protein 22); (x) ICP27 (intermediate early infectious cell protein 27); (y) VP22 (tegument); (z) VP26 (small capsid protein); (aa) TK (thymidine kinase); and (bb) ICP10 (intermediate early infectious cell protein 10).

In one variant antigens will be selected to elicit "unnatural immunity" (Scorza 2016; Nabel et al. 2010), that is, to induce antibody and cellular immunity to viral antigens that are not naturally or effectively recognized by the immune system, but that are capable of providing effective, broad spectrum protection when presented to the immune system in a vaccine.

Confirmation of antigen expression from constructs will be performed in human kidney HEK293 and equine monocytes or dendritic cells. All plasmids will be confirmed by DNA sequencing before transfecting into HEK293 and equine cells. Expression of individual proteins will be confirmed by western blotting using antigen-specific monoclonal or polyclonal antibodies. PBMC from naturally EHV infected horses can be used to probe CTL recognition of cultured cells transfected with antigen-bearing constructs. Endotoxin-free plasmid megapreps will be prepared and plasmids formulated with at least one vaccine candidate for pilot testing. Naïve horses will be vaccinated subcutaneously or mucosally with constructs to evaluate safety and CTL response to the vaccine candidates. This step will confirm safety and characterize the cellular immune response to vaccine antigens by ELISpot and flow cytometry. T cell responses to vaccine antigens in vitro using PBMC from naturally infected horses will also be analyzed. The results of these studies will be used to select candidates for phase 2 challenge studies and to develop effective medicines.

X. Example 9—Coronavirus Constructs

This Example demonstrates the application of similar approaches to those described in the preceding Examples to Coronavirus SARS COV2.

Vaccine compositions comprising gD:antigen fusion protein constructs comprising SARS COV2 antigens are prepared comprising either a single plasmid (comprising both gD:antigen fusion protein-encoding sequences and an EAT-2 polypeptide coding sequence) or two plasmids (one plasmid containing gD:SARS COV2 antigen-encoding sequence and the other plasmid comprising an EAT-2-coding sequence). Constructs generated for the performance of these experiments will either include (1) constructs encoding only gD sequences that do not effectively bind HVEM or (2) constructs that separately contain both HVEM-binding and non-effective-HVEM-binding gD sequences. SARS COV2 antigens may only be contained in the C-terminus of the gD:antigen fusion protein, internally to two gD domains, or both. EAT-2 sequences will comprise human EAT-2 (hEAT-2) or a functional fragment thereof or murine EAT-2 (mEAT-2) or a function fragment thereof or both types of sequences will be included among different constructs.

SARS COV2 antigens contained in the fusion protein(s) expressed by constructs used in the study will include SARS COV2 surface glycoprotein (S), Nucleocapsid (N), Membrane glycoprotein (M) sequences, or combinations thereof. Variants can be generated and tested (either as the only test candidates or in comparison to other candidates) by substitutions introduced in one, several, or all of the N-X-S sequences or N-X-T sequences present in such antigen amino acid sequences. An example of a source of candidate sequences and virus that can be used in testing of vaccine candidate constructs is provided at NCBI Reference Sequence: NC_045512.2 (severe acute respiratory syndrome coronavirus 2 isolate Wuhan-Hu-1, complete genome).

An example of a SARS COV2 S sequence (SEQ ID NO: 14) is shown below (sites for possible modification for variant generation are bolded and underlined): >YP_009724390.1 surface glycoprotein [Severe acute respiratory syndrome coronavirus 2]

MFVFLVLLPLVSSQCVNLTTRTQLPPAYTNSFTRGVYYPDKVFRSSVLHST

QDLFLPFFSNVTWFHAIHVSGTNGTKRFDNPVLPFNDGVYFASTEKSNIIR

GWIFGTTLDSKTQSLLIVNNATNVVIKVCEFQFCNDPFLGVYYHKNNKSWM

ESEPRVYSSANNCTFEYVSQPFLMDLEGKQGNFKNLREFVFKNIDGYFKIY

SKHTPINLVRDLPQGFSALEPLVDLPIGINITRFQTLLALHRSYLTPGDSS

SGWTAGAAAYYVGYLQPRTFLLKYNENGTITDAVDCALDPLSETKCTLKSF

TVEKGIYQTSNFRVQPTESIVRFPNITNLCPFGEVFNATRFASVYAWNRKR

ISNCVADYSVLYNSASFSTFKCYGVSPTKLNDLCFTNVYADSFVIRGDEVR

QIAPGQTGKIADYNYKLPDDFTGCVIAWNSNNLDSKVGGNYNYLYRLFRKS

NLKPFERDISTEIYQAGSTPCNGVEGFNCYFPLQSYGFQPTNGVGYQPYRV

VVLSFELLHAPATVCGPKKSTNLVKNKCVNFNFNGLTGTGVLTESNKKFLP

FQQFGRDIADTTDAVRDPQTLEILDITPCSFGGVSVITPGTNTSNQVAVLY

QDVNCTEVPVAIHADQLTPTWRVYSTGSNVFQTRAGCLIGAEHVNNSYECD

IPIGAGICASYQTQTNSPRRARSVASQSIIAYTMSLGAENSVAYSNNSIAI

PTNFTISVTTEILPVSMTKTSVDCTMYICGDSTECSNLLLQYGSFCTQLNR

ALTGIAVEQDKNTQEVFAQVKQIYKTPPIKDFGGFNFSQILPDPSKPSKRS

FIEDLLFNKVTLADAGFIKQYGDCLGDIAARDLICAQKFNGLTVLPPLLTD

EMIAQYTSALLAGTITSGWTFGAGAALQIPFAMQMAYRFNGIGVTQNVLYE

NQKLIANQFNSAIGKIQDSLSSTASALGKLQDVVNQNAQALNTLVKQLSSN

FGAISSVLNDILSRLDKVEAEVQIDRLITGRLQSLQTYVTQQLIRAAEIRA

SANLAATKMSECVLGQSKRVDFCGKGYHLMSFPQSAPHGVVFLHVTYVPAQ

EKNFTTAPAICHDGKAHFPREGVFVSNGTHWFVTQRNFYEPQIITTDNTFV

SGNCDVVIGIVNNTVYDPLQPELDSFKEELDKYFKNHTSPDVDLGDISGIN

ASVVNIQKEIDRLNEVAKNLNESLIDLQELGKYEQYIKWPWYIWLGFIAGL

IAIVMVTIMLCCMTSCCSCLKGCCSCGSCCKFDEDDSEPVLKGVKLHYT

An example of a SARS COV2 N sequence (SEQ ID NO: 15) is shown below (sites for possible modification are bolded and underlined): >YP_009724397.2 nucleocapsid phosphoprotein [Severe acute respiratory syndrome coronavirus 2]

MSDNGPQNQRNAPRITFGGPSDSTGSNQNGERSGARSKQRRPQGLPNNTAS

WFTALTQHGKEDLKFPRGQGVPINTNSSPDDQIGYYRRATRRIRGGDGKMK

DLSPRWYFYYLGTGPEAGLPYGANKDGIIWVATEGALNTPKDHIGTRNPAN

NAAIVLQLPQGTTLPKGFYAEGSRGGSQAS SRSSSRSRNSSRNSTPGSSRG

TSPARMAGNGGDAALALLLLDRLNQLESKMSGKGQQQQGQTVTKKSAAEAS

KKPRQKRTATKAYNVTQAFGRRGPEQTQGNFGDQELIRQGTDYKHWPQIAQ

-continued

```
FAPSASAFFGMSRIGMEVTPSGTWLTYTGAIKLDDKDPNFKDQVILLNKHI

DAYKTFPPTEPKKDKKKKADETQALPQRQKKQQTVTLLPAADLDDFSKQLQ

QSMSSADSTQA
```

An example of a SARS COV2 M sequence (SEQ ID NO: 16) is shown below (sites for possible modification for variant generation are bolded and underlined):
>YP_009724393.1 membrane glycoprotein [Severe acute respiratory syndrome coronavirus 2]

```
MADSNGTITVEELKKLLEQWNLVIGFLFLTWICLLQFAYANRNRFLYIIKL

IFLWLLWPVTLACFVLAAVYRINWITGGIAIAMACLVGLMWLSYFIASFRL

FARTRSMWSFNPETNILLNVPLHGTILTRPLLESELVIGAVILRGHLRIAG

HHLGRCDIKDLPKEITVATSRTLSYYKLGASQRVAGDSGFAAYSRYRIGNY

KLNTDHSSSSDNIALLVQ
```

Using the above-described variables, candidate constructs will be developed and evaluated in nonclinical settings and then used for human clinical trials.

LISTING OF EXEMPLARY ASPECTS OF THE INVENTION

The following is a non-limiting list of exemplary AOTI, intended to illustrate embodiments OTI in summary form. Such AOTIs include:

1. A CEPESC comprising EA(s) of NAM(s) comprising NS(s) comprising (1) gDPES(s); (2) AgES(s); and (3) ICITMES(s) (e.g., ITICITMES(s)); ICSTAPES(s) (e.g., ITICSTAPES(s)); or CPSTAPES(s);
2. The CEPESC of aspect 1, wherein NAM(s) comprise EAT-2 PPT ES(s);
3. The CEPESC of aspect 2, wherein the EAT-2 PPTs in the CEP comprise human EAT-2 PPTs (EL hEAT-2, an FF thereof, or a FV thereof);
4. A CEPESC comprising EA(s) of NAM(s) comprising NS(s) comprising (1) gDPES(s) and (2) AgES(s) wherein the AgES(s) encoding multiple Ag(s) that expressed in PE(s) comprising SCS(s), MSL(s), FL(s), MSFL(s), or CT;
5. A CEPESC comprising EA(s) of NAM(s) comprising NS(s) comprising (1) gDPES(s) and (2) AgES(s) wherein the AgES(s) encode CD4TCE(s) and CD8TCE(s), wherein the CD4TCE(s) and CD8TCE(s) in the CEP result in DOS CD4 TC IR(s), CD8 TC IR(s), and BC IR(s) when an EA of the composition is delivered to TR(s);
6. A CEPESC comprising EA(s) of NAM(s) comprising NS(s) comprising (1) gDPES(s); (2) AgES(s) wherein the AgES(s) encode Ag(s) comprising unnatural immunity Ag(s), AgV(s) from which decoy epitope(s) are removed, subdominant epitope(s), cryptic epitope(s), or CT;
7. A CEPESC comprising EA(s) of NAM(s) comprising NS(s) comprising (1) gDPES(s); (2) AgES(s) encoding AgV(s) including DIV(s);
8. The CEPESC of aspect 7, wherein the DIV(s) comprise GSRV(s);
9. A CEPESC comprising EA(s) of NAM(s) comprising NS(s) comprising (1) gDPES(s); (2) AgES(s); and (3) PTPSES(s), wherein the CEP comprises Ag(s) associated with ITS(s);
10. The CEPESC of aspect 9, wherein ITS(s) comprise PTPS(s);
11. The CEPESC of aspect 10, wherein the PTPS(s) comprise PolyUb(s);
12. A CEPESC comprising EA(s) of NAM(s) comprising NS(s) comprising (1) gDPES(s) and (2) AgES(s), wherein the gDP(s) (i) lack a gD TMD, (ii) exhibit DOS reduced affinity for HVEM than HSV-1 gD, or (iii) both (i) and (ii), and optionally comprises a gDSS;
13. A CEPESC comprising EA(s) of NAM(s) comprising NS(s) encoding gDAgFP(s) comprising gDS(s) and Ag(s) wherein Ag(s) are positioned downstream of any gDS(s) in gDAgFP(s);
14. A CEPESC comprising EA(s) of NAM(s) comprising NS(s) comprising (1) gDPES(s), (2) AgES(s), and (3) NGDPCIES(s);
15. The CEPESC of aspect 14, wherein the NGDPCI is a multimeric trap PPT;
16. The CEPESC of aspect 14 or aspect 15, wherein the NGDPCI blocks a CD112R or PD-1 checkpoint pathway;
17. A CEPESC comprising EA(s) of NAM(s) comprising NS(s) comprising (1) gDPES(s) and (2) AgES(s), and (3) NASM(s);
18. The CEPESC of aspect 17, wherein the NASM(s) comprise triclosan resistant marker ES(s);
19. The CEPESC according to any one of aspects 1-18, wherein the NS(s) comprise EEI(s) that DOS enhance expression of ES(s);
20. The CEPESC of aspect 19, wherein the NS(s) comprise SCUP(s) associated with EPES(s);
21. The CEPESC of any one of aspects 1-20, wherein the AgES(s) express Ag(s) that comprise CRA(s), PCRA(s), or both;
22. The CEPESC of any of aspects 1-21, where EP(s) comprise a NGDICRTS;
23. The CEPESC of aspect 22, wherein the NGDICRTS is a DEC-205-TS, such as a DEC-205-binding trap FP comprising Ag(s);
24. A CEPESC according to any one of aspects 1-23, wherein the CEPESC comprises EA(s) of at least two NAM(s), wherein the at least two NAM(s) comprise different ES(s) encoding different EP(s);
25. The CEPESC of aspect 24, where at least 1 NAM encodes a gDPAgFP and ≥1 other NAM encodes (a) Ag(s), (b) EAT-2 PPT(s), (c) NGDPCI(s), or (d) CT;
26. A CEPESC according to any of aspects 1-25, where NAM(s) are NAV(s);
27. A CEPESC according to aspect 26, wherein the NAM(s) are associated with CaPNPs, wherein the CaPNPs DOS enhance IR(s);
28. A CEPESC comprising features of 2 or more of aspects 1-27;
29. The CEPESC of aspect 28, wherein the CEPESC comprises features of aspect—620—and aspect 6 (i.e., (1) gDPES(s); (2) AgES(s); and (3) ICITMES(s) (e.g., ITICITMES(s)); ICSTAPES(s) (e.g., ITICSTAPES(s)); or CPSTAPES(s), wherein the AgES(s) encode Ag(s) comprising unnatural immunity Ag(s), AgV(s) from which decoy epitope(s) are removed, subdominant epitope(s), or CT);
30. The CEPESC of aspect 28, wherein the CEPESC comprises features of aspect 2 and aspect 8 (i.e., comprises EAT-2 PPT ES(s) and AgES(s) encoding DIV AgV(s) that comprise GSRV(s));
31. The CEPESC of aspect 28, wherein the CEPESC comprises features of aspects 2 and 10 and one of aspects 14, 17, 19, 21, 22, and 28;
32. A CEPESC comprising features of 3 or more of aspects 1-27.

33. The CEPESC according to aspect 32, wherein the CEPESC comprises features of aspects 1, 9, and 19;
34. The CEPESC according to aspect 33, wherein the CEPESC comprises features of aspects 2, 10, and 19;
35. The CEPESC of aspect 32, wherein the CEPESC comprises features of aspects 1 & 4, and one of aspects 5, 6, 7, 9, 13, 14, 17, and 19;
36. The CEPESC according to aspect 32, wherein the CEPESC comprises features of aspects 1 and 9, and one of aspects 14, 17, and 19;
37. The CEPESC of aspect 32, wherein the CEPESC comprises features of aspects 1 and 7, and one of aspects 9, 14, 17, and 19;
38. The CEPESC of aspect 3233, wherein the CEPESC comprises features of aspects 12, and two of aspects 14, 17, and 28;
39. The CEPESC according to aspect 32, wherein the CEPESC comprises features of aspects 1 and 14 and one of aspects 1 and 17;
40. A CEPESC comprising features of 4 or more of aspects 1-28;
41. The CEPESC of aspect 40, wherein the CEPESC comprises features of aspects 2, 10, and 28 and one of aspects 4, 5, 6, 7, 14, 17, 19, 21, and 22;
42. The CEPESC of aspect 40, wherein the CEPESC comprises features of aspects 2, 10, and 19 and one of aspects 4, 5, 6, 7, 14, 17, 21, and 22;
43. The CEPESC of aspect 40, wherein the CEPESC comprises features of aspects 2, 7, and 10, and of aspects 4, 5, 6, 14, 17, 19, 21, and 22;
44. The CEPESC of aspect 40, wherein the CEPESC comprises features of aspects 2, 7, and 17, and 1 of aspects 4, 5, 6, 14, 19, 21, & 22;
45. The CEPESC of aspect 40, wherein the CEPESC comprises features of aspects 12, 17, and one of aspects 7, 14, 17, 19, 21, and 22;
46. The CEPESC of aspect 40, wherein the CEPESC comprises features of aspects 10, 19, 28, and one of aspects 4, 5, 6, 14, 17, 19, 21, and 22;
47. A CEPESC comprising features of 5 or more of aspects 1-28;
48. A CEPESC comprising features of 6 or more of aspects 1-28;
49. The CEPESC of aspect 48, wherein the CEPESC comprises features of aspects 2, 7, 10, 17, 19, and 28;
50. A CEPESC comprising features of 8 or more of aspects 1-28;
51. The CEPESC of aspect 48, wherein the CEPESC comprises features of aspects 2, 5, 7, 10, 17, 19, & 28 and one or more of aspects 6, 12, 13, & 21;
52. The CEPESC of aspect 48, wherein the CEPESC comprises features of aspects 2, 5, 7, 11, 18, 19, and 28 & ≥1 of aspects 6, 12, 21, 22, and 24;
53. The CEPESC of any one of aspects 1-52, wherein the CEPESC encodes 1 PPT that exhibits IR-inducing checkpoint modulation in TR(s);
54. The CEPESC of aspect 53, wherein the CEPESC encodes ≥2 PPTs that exhibit IR-inducing checkpoint modulation in TR(s);
55. The CEPESC of any one of aspects 1-123, where NS(s) encode ≥2 gDPs;

56. The CEPESC of aspect 55, wherein the CEPESC encodes ≥2 gDAgFPs;

57. The CEPESC of any one of aspects 1-56, wherein the NS(s) comprise ISNS(s) that DOS induce IR(s) in TR(s);

58. The CEPESC of any of aspects 1-57, where NS(s) encode NonCMIP(s);

59. The CEPESC of aspect 58, where NCMIP(s) PCG-COOCO Th1 cytokine(s);

60. The CEPESC of any one of aspects 1-60, wherein the CEPESC is characterized by (a) not encoding or comprising any mAb PPT; (b) not comprising viral sequences other than any gDSES(s), regulatory elements, or viral AgES(s); (c) not comprising or expressing any cytokine(s); or (d) a combination of (a)-(c);

61. The CEPESC of any one of aspects 1-60, wherein the CEPESC comprises NS(s) that encode(s) gDP(s) comprising enhanced nectin-1 binding WRT to HSV-1 gD; no detectable HVEM binding; or both;

62. The CEPESC of any one of aspects 1-60, wherein the NS(s) encode at least one gDP that consists essentially of a HVEMBD;

63. The CEPESC of any one of aspects 1-60, wherein the CEPESC encode(s) Ag-associated ITS(s), e.g., endosome TS(s), lysosome TS(s), ERTPS(s), or CT;

64. The CEPESC of any one of aspects 1-63, wherein the CEPESC encodes TCE(s) associated with flanking sequence(s); encodes editope(s); or both;

65. The CEPESC of any one of aspects—620-64, wherein the NS(s) encode DCA-associated BCE(s);

66. The CEPESC of aspect 65, wherein the Ag(s) comprising the BCE(s) are AgV(s) comprising a reduced number of BCEs WRT to its WTC;

67. The CEPESC of any one of aspects 1-64, wherein the NS(s) do not encode any known or readily identifiable DCA-associated BCEs;

68. The CEPESC of any 1 of aspects 1-67, wherein the NS(s) encode at least two PEs, 1 or both optionally forming part of gDAgFP(s);

69. The CEPESC of any one of aspects 1-68, wherein NS(s) encode dominant epitope(s) and subdominant epitope(s), wherein immunodominance is managed such that MGAOA Ag(s) in the CEP induce DOS IRs;

70. The CEPESC of any of aspects 1-69, where NS(s) are RNA(s);

71. The CEPESC of aspect 70, wherein the RNA is characterized by comprising (a) a polyA tail of about 100-200 nt, such as about 120-about 150 nt in length; (b) a 5' cap that detectably enhances the stability of the RNA in TR(s); (c) a 7-methyl-guanosine residue joined to the 5'-end of the nucleotide sequence via a 5'-5' triphosphate; (d) an expression-enhancing 5' UTR (e.g., a HSP 70 5' UTR); or CT;

72. The CEPESC of aspect 70 or aspect 71, wherein the RNA molecule comprises (a) one or more pseudouridine nucleosides, (b) an at least partial phosphorothioate backbone, or (c) a combination thereof;

73. The CEPESC of any one of aspects 1-73, wherein gDP(s) in the CEP comprise sequence(s) that are RVRHRSIOI to SEQ ID NO:64 or SEQ ID NO:56 and detectably bind(s) nectin-1 or a homolog thereof;

74. The CEPESC of aspect 74, wherein the gDP exhibits significantly reduced HVEM binding than HSV-1 gD;

75. The CEPESC of aspect 73 or aspect 74, wherein gDP(s) comprise sequence(s) that are RVRHRSIOI to SEQ ID NO: 78;

76. The CEPESC of any one of aspects 73-75, wherein gDP(s) do not comprise any sequence that exhibits more than about 60% amino acid sequence identity to SEQ ID NO: 77;

77. The CEPESC of aspect 76, wherein gDP(s) do not comprise any AARS that exhibits more than about 65% amino acid sequence identity to SEQ ID NO: 76;

78. The CEPESC of any one of aspects 1-77, wherein gDP(s) comprise sequence(s) that are RVRHRSIOI to SEQ ID NO:65;
79. The CEPESC of any one of aspects 1-78, wherein gDP(s) comprise sequence(s) that are RVRHRSIOI to SEQ ID NO:66;
80. The CEPESC of any one of aspects 1-79, wherein gDP(s) comprise sequence(s) that are RVRHRSIOI to SEQ ID NO:68;
81. The CEPESC of any one of aspects 1-80, wherein gDP(s) comprise sequence(s) that are RVRHRSIOI to SEQ ID NO:70;
82. The CEPESC of any one of aspects 1-81, wherein gDP(s) comprise sequence(s) that are RVRHRSIOI to SEQ ID NO:71;
83. The CEPESC of any one of aspects 1-82, wherein gDP(s) comprise sequence(s) that are RVRHRSIOI to SEQ ID NO:72;
84. The CEPESC of any one of aspects 1-83, wherein gDP(s) comprise sequence(s) that are RVRHRSIOI to SEQ ID NO:73;
85. The CEPESC of any one of aspects 1-84, wherein gDP(s) comprise sequence(s) that are RVRHRSIOI to SEQ ID NO:74;
86. The CEPESC of any one of aspects 1-77, wherein gDP(s) comprise sequence(s) RVRHRSIOI to SEQ ID NO:79 and that functions as a gDSS;
87. The CEPESC of any one of aspects 1-86, wherein gDP(s) in the CEP lack any functional gD TMD;
88. The CEPESC of aspect 87, wherein gDP(s) lack any sequence that is RVRHRSIOI to SEQ ID NO:81;
89. The CEPESC of aspect 87 or aspect 88, wherein gDP(s) lack any sequence RVRHRSIOI to SEQ ID NO:75;

90. The CEPESC of any one of aspects 1-89, wherein gDP(s) comprise sequence(s) that are RVRHRSIOI to SEQ ID NO:82;

91. The CEPESC of any one of aspects 1-90, wherein gDP(s) comprise a gDS that when analyzed PFAM, Interpro, or CDD Search is predicted to comprise a Herpesvirus glycoprotein D/GG/GX domain with an E-value of 10e-10 or less;

92. The CEPESC of any one of aspects 1-91, wherein the CEP comprises gDAgFP(s) comprising (a) a first gDS (gDS1) that is RVRHRSIOI to AAs 23-244 of HSV-1 gD & (b) a second gDS (gDS2) that is RVRHRSIOI to AAs 244-340 of HSV-1 gD, and (c) Ag(s) positioned between gDS1 and gDS2; Ag(s) positioned downstream of gDS2; or both;

93. The CEPESC of any one of aspects 1-92, wherein gDP(s) comprise gDS(s) that exhibit at least about 25% amino acid sequence identity and at least about 55% amino acid sequence similarity to SEQ ID NO:56, (iii) exhibits at least about 70% identity and at least about 75% sequence similarity to a sequence of at least one homolog of HSV-1 gD; and (iv) comprises a sequence according to the formula X1-X2-X3-X4-X5-X6-X7-X8-X9-X10--C--X12-X13-X14-X15--L--X17-X18-X19-X20-X21-X22-X23-X24-X25-X26-X27-X28-X29-X30-X31-X32-X33-X34-X35-X36-X37-X38--W--X40-X41-X42-X43-X44-X45-X46--C--X48-X49-X50-X51-X52-X53-X54-X55-X56-X57-X58--C--X60-X61-X62-X63-X64-X65-X66-X67--C--X69-X70-X71-X72-X73-X74-X75--W--X77-X78-X79-X80-X81-X82-X83-X84-X85-X86-X87-X88-X89-X90-X91--G--X93-X94-X95-X96-X97--P--X99-X100-X101-X102--G--X104--Y--X106-X107-X108-X109-X110-X111-X112-X113-X114-X115-X116-X117-X118-X119-X120-X121-X122, wherein (i) X2, X6, X7, X10, X15, X19, X23, X24, X27, X28, X42, X43, X44, X53, X57, X60, X64, X67, X69, X70, X73, X77, X79, X82, X86, X102, X110, X115, X116, and X117 can be any residue; (ii) X78 can be any residue or is absent; and (iii) X1 is V, T, or N, in one aspect is V or T; X3 is a Y or H; X4 an A, T, V, or L; X5 is a V, T, R, or I; X8 is empty or any residue (S); X9 is an R, A, D, or E; X12 is an R, D, G, or S; X13 is an S, M, V, F; X14 is V, L, or A; X17 is an N, I, or W; X18 is an A, S, or P; X20 is an S, P, T, or G; X21 is an E, Q, D, or N; X22 is an A, V, P, or I; X25 is I, T, L, V, or M; X26 is V, L, or I; X29 is an A, L, Q, or I; X30 is any 0-6 residues; X31 is a P, V, S, L or Q; X32 is any 0-7 residues; X33 is a Y or F; X34 is an N, R, D, or E; X35 is an L or A; X36 is a T, H, L, or S; X37 is an I, V, or L, X38 is an A, I, S or V; X40 is F or Y; X41 is R, K, or V; X45 is an N, G, D, A, or M; X46 is 0-6 of any residues; X48 is an A, G, E, or T, or is absent; X49 is an I, R, H, Y, or is absent; X50 is a P or L; X51 is a I, L, or M; X52 is a T, Y, L, or F; X54 is a M, I, R, or K; X55 is an E, D, or Q; X56 is a Y, F, or M; X58 is an E, D, N, or L; X61 is a Y, P, T, or D; X62 is an N, R, D, K, Q, or V; X63 is a K, Q, E, or R; X65 is an L or F; X66 is a G or S; X71 is an R, K, S, or Q; X72 is a T, N or S, in one aspect T or S; X74 is a P, G, S, D, or Q; X75 is an R, F, M, W, or Y; X80 is a Y, L, or S; X81 is a D, A, V, or T; X83 is an F, Y, T, or S; X84 is an S, A, M, or T; X85 is an A, Y, F, or L; X87 is an S, T, or G; X88 is an E, D, or R; X89 is a D or N; X90 is an N, E, or G; X91 is an L or A; X93 is a F or L; X94 is an L, I, V, or T; X95 is a M, I, F, or L; X96 is a H, A, V, M, or F; X97 is an A or S; X99 is an F, R, Q, P, or A; X100 is an E, L, F, or A; X101 is a T, V, N, or L; X104 is a T, Q, or L; X106 is an L, R, or T; X107 is an R or L; X108 is an L, A, V, or T; X109 is a V, L, or I; X111 is an I or V; X112 is an N, D, E, or G; X113 is a D, G, N, or R; X114 is a W, T, V, E, D, S, or F; X118 is a T, S, or A; X119 is a Q, D, or L; X120 is a F, I, or V; X121 is a I, M, L, or T; and X122 is a L, V, or F (FORMULA 1; SEQ ID NO: 744);

94. The CEPESC of aspect 93, wherein the gDP(s) comprise(s) a sequence according to the formula X1-X2-X3-X4-X5-X6-X7-X8-X9-X10--C--X12-X13-X14-X15--L--X17-X18-X19-X20-X21-X22-X23-X24-X25-X26-X27-X28-X29-X30-X31-X32-X33-X34-X35-X36-X37-X38--W--X40-X41-X42-X43-X44-X45-X46--C--X48-X49-X50-X51-X52-X53-X54-X55-X56-X57-X58--C--X60-X61-X62-X63-X64-X65-X66-X67--C--X69-X70-X71-X72-X73-X74-X75--W--X77-X78-X79-X80-X81-X82-X83-X84-X85-X86-X87-X88-X89-X90-X91--G--X93-X94-X95-X96-X97--P--X99-X100-X101-X102--G--X104--Y--X106-X107-X108-X109-X110-X111-X112-X113-X114-X115-X116-X117-X118-X119-X120-X121-X122, wherein X1 is V, T, or N, in one aspect is V or T; X2 is Y, R, K; X3 is a Y or H; X4 an A, T, V, or L; X5 is a V, T, R, or I; X6 is an L, S, P, Y, or R; X7 is an E, A, L, T, D, M, or V; X8 is empty or any residue (S); X9 is an R, A, D, or E; X10 is an A, P, N, S, or G; X12 is an R, D, G, or S; X13 is an S, M, V, F; X14 is V, L, or A; X15 is an L, A, V, or E; X17 is an N, I, or W; X18 is an A, S, or P; X19 is a P, D, F, I, E, or N; X20 is an S, P, T, or G; X21 is an E, Q, D, or N; X22 is an A, V, P, or I; X23 is an P, G, D, V, K, or E; X24 is a Q, R, Y, A, S, or D; X25 is I, T, L, V, or M; X26 is V, L, or I; X27 is an R, W, N, L, or S; X28 is a G, E, S, T, or A; X29 is an A, L, Q, or I; X30 is any 0-6 residues; X31 is a P, V, S, L or Q; X32 is any 0-7 residues; X33 is a Y or F; X34 is an N, R, D, or E; X35 is an L or A; X36 is a T, H, L, or S; X37 is an I, V, or L, X38 is an A, I, S or V; X40 is F or Y; X41 is R, K, or V; X42 is M, I, T, L, or V; X43 is G, E, A, S, T, or I; X44 is G, S, D, R, K, Q, or D; X45 is an N, G, D, A, or M; X46 is 0-6 of any residues; X48 is an A, G, E, or T, or is absent; X49 is an I, R, H, Y, or is absent; X50 is a P or L; X51 is a I, L, or M; X52 is a T, Y, L, or F; X53 is a V, Y, F, L, or R; X54 is a M, I, R, or K; X55 is an E, D, or Q; X56 is a Y, F, or M; X57 is a T, A, Y, R, or F; X58 is an E, D, N, or L; X60 is a S, E, D, Q, or G; X61 is a Y, P, T, or D; X62 is an N, R, D, K, Q, or V; X63 is a K, Q, E, or R; X64 is a S, H, V, P, E, or L; X65 is an L or F; X66 is a G or S; X67 is an A, Y, R, T, or E; X69 is a P, R, K, S, A, or L; X70 is an I, Y, R, V, L, M, or K; X71 is an R, K, S, or Q; X72 is a T, N or S, in one aspect T or S; X73 is a Q, P, T, L, or A; X74 is a P, G, S, D, or Q; X75 is an R, F, M, W, or Y; X77 is an N, D, W, S, L, K, or A; X78 is absent or is a S, T, R, E, P, or V; X79 is a Y, F, P, R, S, or D; X80 is a Y, L, or S; X81 is a D, A, V, or T; X82 is an S, G, M, K, or P; X83 is an F, Y, T, or S; X84 is an S, A, M, or T; X85 is an A, Y, F, or L; X86 is a V, P, T, I, or L; X87 is an S, T, or G; X88 is an E, D, or R; X89 is a D or N; X90 is an N, E, or G; X91 is an L or A; X93 is a F or L; X94 is an L, I, V, or T; X95 is a M, I, F, or L; X96 is a H, A, V, M, or F; X97 is an A or S; X99 is an F, R, Q, P, or A; X100 is an E, L, F, or A; X101 is a T, V, N, or L; X102 is an A, E, S, D, or Q; X104 is a T, Q, or L; X106 is an L, R, or T; X107 is an R or L; X108 is an L, A, V, or T; X109 is a V, L, or I; X110 is a K, Y, S, I, V, T, or Q; X111 is an I or V; X112 is an N, D, E, or G; X113 is a D, G, N, or R; X114 is a W, T, V, E, D, S, or F; X115 is a T, V, N, P, F, M, or A; X116 is an E, A, I, T, F, or Q; X117 is I, Y, L, V, S, or T; X118 is a T, S, or A; X119 is a Q, D, or L; X120 is a F, I, or V; X121 is a I, M, L, or T; and X122 is a L, V, or F (FORMULA 2, SEQ ID NO: 745);

95. The CEPESC of aspect 94, wherein the gDP(s) comprise(s) a sequence according to the formula
$\underline{V}$--X2-X3-X4-X5-X6-X7-X8-X9-X10--$C_1$--X12-X13-X14-X15--
$\underline{L}$--X17-X18-X19-X20-X21-X22-X23-X24-X25-X26-X27-X28-X29-X30-X31-X32--
$\underline{Y}$--X34-X35-X36-X37-X38--
$\underline{W}$--X40-X41-X42-X43-X44-X45-X46--$C_2$--X48-X49-X50-X51-X52-X53-X54--$\underline{E}$--
$\underline{Y}$--X57-X58--$C_3$--X60-X61-X62-X63-X64-X65--
$\underline{G}$--X67--$C_4$--X69-X70-X71-X72-X73-X74-X75--W--X77-X78-X79-X80-X81-X82-X83-X84-X85-X86-X87-X88--
$\underline{D}$--X90--$\underline{L}$---$\underline{G}$--X93-X94-X95-X96-X97--
$\underline{P}$--X99-X100-X101-X102--$\underline{G}$--X104--$\underline{Y}$--X106--
$\underline{R}$--X108-X109-X110-X111-X112-X113-X114-X115-X116-X117-X118-X119-X120-X121-X122, wherein $C_1$-$C_4$ are cysteines (but numbered for convenience of reference); X2 is Y, R, K; X3 is a Y or H; X4 an A, T, V, or L; X5 is a V, T, R, or I; X6 is an L, S, P, Y, or R; X7 is an E, A, L, T, D, M, or V; X8 is empty or any residue (S); X9 is an R, A, D, or E; X10 is an A, P, N, S, or G; X12 is an R, D, G, or S; X13 is an S, M, V, F; X14 is V, L, or A; X15 is an L, A, V, or E; X17 is an N, I, or W; X18 is an A, S, or P; X19 is a P, D, F, I, E, or N; X20 is an S, P, T, or G; X21 is an E, Q, D, or N; X22 is an A, V, P, or I; X23 is an P, G, D, V, K, or E; X24 is a Q, R, Y, A, S, or D; X25 is I, T, L, V, or M; X26 is V, L, or I; X27 is an R, W, N, L, or S; X28 is a G, E, S, T, or A; X29 is an A, L, Q, or I; X30 is any 0-6 residues; X31 is a P, V, S, L or Q; X32 is any 0-7 residues; X34 is an N, R, D, or E; X35 is an L or A; X36 is a T, H, L, or S; X37 is an I, V, or L, X38 is an A, I, S or V; X40 is F or Y; X41 is R, K, or V; X42 is M, I, T, L, or V; X43 is G, E, A, S, T, or I; X44 is G, S, D, R, K, Q, or D; X45 is an N, G, D, A, or M; X46 is 0-6 of any residues; X48 is an A, G, E, or T, or is absent; X49 is an I, R, H, Y, or is absent; X50 is a P or L; X51 is a I, L, or M; X52 is a T, Y, L, or F; X53 is a V, Y, F, L, or R; X54 is a M, I, R, or K; X57 is a T, A, Y, R, or F; X58 is an E, D, N, or L; X60 is a S, E, D, Q, or G; X61 is a Y, P, T, or D; X62 is an N, R, D, K, Q, or V; X63 is a K, Q, E, or R; X64 is a S, H, V, P, E, or L; X65 is an L or F; X67 is an A, Y, R, T, or E; X69 is a P, R, K, S, A, or L; X70 is an I, Y, R, V, L, M, or K; X71 is an R, K, S, or Q; X72 is a T, N or S, in one aspect T or S; X73 is a Q, P, T, L, or A; X74 is a P, G, S, D, or Q; X75 is an R, F, M, W, or Y; X77 is an N, D, W, S, L, K, or A; X78 is absent or is a S, T, R, E, P, or V; X79 is a Y, F, P, R, S, or D; X80 is a Y, L, or S; X81 is a D, A, V, or T; X82 is an S, G, M, K, or P; X83 is an F, Y, T, or S; X84 is an S, A, M, or T; X85 is an A, Y, F, or L; X86 is a V, P, T, I, or L; X87 is an S, T, or G; X88 is an E, D, or R; X90 is an N, E, or G; X93 is a F or L; X94 is an L, I, V, or T; X95 is a M, I, F, or L; X96 is a H, A, V, M, or F; X99 is an F, R, Q, P, or A; X100 is an E, L, F, or A; X101 is a T, V, N, or L; X102 is an A, E, S, D, or Q; X104 is a T, Q, or L; X106 is an L, R, or T; X108 is an L, A, V, or T; X109 is a V, L, or I; X110 is a K, Y, S, I, V, T, or Q; X111 is an I or V; X112 is an N, D, E, or G; X113 is a D, G, N, or R; X114 is a W, T, V, E, D, S, or F; X115 is a T, V, N, P, F, or A; X116 is an E, A, I, T, F, or Q; X117 is I, Y, L, V, S, or T; X118 is a T, S, or A; X119 is a Q, D, or L; X120 is a F, I, or V; X121 is a I, M, L, or T; and X122 is a L, V, or F (FORMULA 3, SEQ ID NO: 746);

96. The CEPESC of any of aspects 93-95, wherein the gD sequence further comprises a sequence downstream of X122 according to the formula Xa--$\underline{C_5}$--X(1)-X(2)-Xb-X(3)--$\underline{C_6}$, where Xa is any 6 to 8 residues; X(1) is Y or F; X(2) is A or S; Xb is any 7-11 AAs; & X(3) is A, L, or W (FORMULA 4, SEQ ID NO: 747);

97. The CEPESC of aspect [1190], wherein one or more of $C_1$ and $C_5$, $C_2$ and $C_6$, and $C_3$ and $C_4$ form cysteine-cysteine double bonds;

98. The CEPESC of aspect [1191], wherein all of $C_1$ and $C_5$, $C_2$ and $C_6$, and $C_3$ and $C_4$ form cysteine-cysteine double bonds;

99. The CEPESC of any one of aspects [1190]-[1191], wherein the gD sequence further comprises a sequence downstream of the Formula 4 sequence according to the formula: V--X(4)-V--X(5)-X(6)-X(7)--G--X(8)--L--X(9)--P--X(10)--F--Xc-X(11)--V--X(12)-X(13)-X(14)-Y, wherein X(4) is any residue, in one aspect an S or T; X(5) is any residue, in one aspect an I; X(8) is any residue, in one aspect an M or a V; X(9) is absent or any residue; X(10) is any 1-2 residues, in one aspect comprising an E or a P; Xc is any 4-8 residues; X(11) is any residue, in one aspect a T or a V; X(12) is any residue, in one aspect an A or an N; X(13) is any residue; in one aspect a V, L, or is absent; X(14) is any residue, in one aspect an L or a W or is absent (FORMULA 5, SEQ ID NO:748);

100. The CEPESC of aspect 99, wherein the Formula 5 sequence has a sequence according to the formula: V--T--V--D--S--I--G--M--L--X(9)--P--R--F--Xc--T--V--X(12)-X(13)-X(14)-Y (FORMULA 6, SEQ ID NO: 749); 101. The CEPESC of aspect 100, where the Formula 6 sequence further comprises a sequence per: S--Xd--G--V--T--V--D--S--I--G--M--L--X(9)--P--R--F--Xc--T--V-X(12)-X(13)-X(14)-Y, where Xd is any 5-6 AAs (FORMULA 7, SEQ ID NO: 750);

102. The CEPESC of aspects [1190]-[1191], wherein the gD sequence further comprises a sequence downstream of the Formula 4 sequence according to the formula Xx-V-T-V-D-S-I-G-M-L-P-R-F-Xy-T-V-Xz-Y, wherein Xx is any 6-10 residues, in one aspect 9 residues; Xy is any 5-9 residues, in one aspect 6 residues; and Xz is any 0-4 residues, in one aspect 2 residues (FORMULA 8, SEQ ID NO: 751);

103. The CEPESC of aspects 93-102, wherein the gDD sequence comprises a sequence upstream of the Formula 1, Formula 2, or Formula 3 sequence according to the formula: X.1-X.2-L-X.3-X.4--L--X(I)--V, wherein X.1 is any residue, in one aspect P or A; X.2 is any residue, in one aspect V or L; X.3 is any residue, in one aspect D or A; X.4 is any residue, in one aspect G or A; and X(I) is any about 7-9 residues (FORMULA 9, SEQ ID NO: 752);

104. The CEPESC of aspect 103, wherein the Formula 9 sequence comprises a sequence per the formula: P--X.2--L--X.3--G--X.4--L--X(I)--V--Y--H (FORMULA 10, SEQ ID NO: 753);

105. The CEPESC of aspect 104, wherein the Formula 9 sequence comprises a sequence according to the formula: X.1-X.2--L--X.3-X.4--L--X(I)--V--X(II)--P-X.5--F--X.6--P--P--X.7-X.8--P--X.9--T, wherein X(II) is any 4-10 residues, X.5 is any residue or is absent, in one aspect T or is absent; X.6 is any residue, in one aspect Q or P; X.7 is any residue, in one aspect S or A; X.8 is any residue, in one aspect L or Y; and X.9 is any residue, in 1 aspect I or Y (FORMULA 11, SEQ ID NO: 754);

106. The CEPESC of aspects 93-102, wherein the gDD sequence comprises a sequence upstream of the Formula 1, Formula 2, or Formula 3 sequence per the formula: P-X-L-X-R-X-X-X-X-X-X-X-R-V-Y-H, wherein X can be any residue (FORMULA 12, SEQ ID NO: 755);

107. The CEPESC of any one of aspects 1-106, wherein any gDPAgFP encoded by NSs of the CEPESC lacks a gD profusion domain;

108. The CEPESC of aspects 1-107, wherein gDP(s) comprise gDS(s) including a first set of residues and a second set of residues that map to within about 5 angstroms of the patch1&patch 2 nectin-1 binding domains of HSV-1 gD or HSV-gD when structurally aligned (e.g., HSV-2 gD patch1 residues comprising P23, L25 to Q27, F223, N227, V231, and Y234 and HSV-2 gD patch 2 residues comprising R36 to H39, Q132, R134, P198, and V214 to R222);

109. The CEPESC of any one of aspects 93-108, wherein gDP(s) comprise gDS(s) that detectably bind HVEM under typical gD:HVEM binding conditions;

110. The CEPESC of any one of aspects 93-108, wherein gDP(s) do not bind HVEM under typical conditions;

111. A CEPESC according to any one of aspects 1-110, comprising gDP(s) that comprise a gDSS, a gD PFD, or both, and lacks any gD RBD;

112. The CEPESC of aspect 111, wherein the gDP(s) lacking any gD RBD comprise a NGD RBD, such as an ITICRTS, e.g., a DEC-205-binding domain, a PD-1 binding domain, or a CD112R binding domain;

113. The CEPESC of any one of aspects 1-112, wherein the CEP comprises 2 polyubiquitin sequences, each of the ≥2 polyUb sequences being AW Ag(s);

114. The CEPESC of any of aspects 1-113, where the CEPESC encodes degron(s);

115. The CEPESC of any one of aspects 1-114, wherein the CEPESC comprises 3+ NAM(s) comprising different NSs, at least two of the NAM(s) comprising NSs encoding different EPs (e.g., a 1$^{st}$ NAM comprising a gDAgFPES; a 2$^{nd}$ NAM comprising an EAT-2 PPT ES; and a 3$^{rd}$ NAM comprising an ISNS, a NS comprising a NGDPCIES, or a CT);

116. The CEPESC of any one of aspects 1-115, wherein gDP(s) of the CEP are MCRT gD(s) of a-HVs that typically infect a first type of TR and MGASAOA of the Ag(s) are associated with DCA(s) that infect or are of a second type of TR, wherein the 1$^{st}$ & 2$^{nd}$ types of TRs are different species;

117. The CEPESC of any one of aspects 1-116, wherein EP(s) comprise DIV(s) and the CEPESC produces DOS reduced CSAE(s) in TR(s);

118. The CEPESC of aspect 117, wherein an EA of the CEPESC does not result in more than 15%, 10%, or 5% occurrence of CSAE(s) in TR(s);

119. The CEPESC of aspect 118, wherein CSAE(s) comprise Vaccine-Associated Enhanced Respiratory Disease (VAERD);

120. The CEPESC of any one of aspects 1-119, wherein the NS(s) encode an EAT-2 PPT according to M-D-L-P-Y-Y-H-G-Xα-L-T-K-X1-X2-C-E-X3-L-L-L-K-Xα-G-V-D-G-N-F-L-X4-R-D-S-E-S-X5-P-G-X6-L-C-L-C-V-S-F-K-X7-X8-V-Y-X9-Y-R-I-F-R-E-K-H-G-Y-Y-R-I-Q-T-Xα-Xα-Xα-X10-P-X11-Xα-X12-F-P-X13-L-X14-E-L-X15-S-K-X16-Xα-K-P-X17-Q-G-X18-V-V-H-L-Xα-X19-P-I-Xα-R-X20-X21-Xα-Xα-Xα-R-Xα-R-G-X22-X23-L-E-L-X24-X25-X26-Xα-N-X27-X28-Xα-X29-Y-V-D-V-L-P (SEQ ID NO: X, FORMULA Z), wherein Xα represents any AA, X1 is Q or R; X2 is D or E; X3 is T or A; X4 is L or I; X5 is I or V; X6 is V or A; X7 is N or K; X8 is I or L; X9 is T or S; X10 is S or T; X11 is K or R; X12 is V or I; X13 is S or N; X14 is K or Q; X15 is I or V; X16 is F or Y; X17 is N or G; X18 is M or L; X19 is K or N; X20 is T or N; X21 is S or N; X22 is L or M; X23 is K or E; X24 is E or N; X25 is T or V; X26 is F or Y; X27 is S or T; X28 is N or D; and X29 is D or E;

121. The CEPESC of any one of aspects 1-120, wherein gDP(s) comprise a sequence that is SVSHSOCE to a gDS comprising SEQ ID NO: 56;

122. The CEPESC of any one of aspects 1-121, wherein the Ag(s) expressed by the AgES(s) comprise cancer Ag(s);

123. The CEPESC of any one of aspects 1-121, wherein Ag(s) encoded by the AgES(s) comprise pathogen-associated Ag(s);

124. The CEPESC of aspect 123, where Ag(s) CPCG-COOCO ASFV Ag(s);

125. The CEPESC of aspect 124, wherein the ASFV Ag(s) comprise sequence(s) of ≥8 AAs that is HRSIOI to a sequence of SEQ ID NO:23;

126. The CEPESC of aspect 124, wherein the ASFV Ag(s) comprise sequence(s) of ≥20 AAs that is HRSIOI to a portion of SEQ ID NO:23;

127. The CEPESC of aspect 126, wherein ASFV Ag(s) comprise a sequence of ≥50 amino that is HRSIOI to a portion of SEQ ID NO:23;

128. The CEPESC of aspect 124, wherein the CEPESC comprises ASFV Ag(s) that are HRSIOI to ≥8 AAs, ≥12 AAs, or ≥20 AAs, of SEQ ID NO:237;

129. The CEPESC of any one of aspects 124-128, wherein the ASFV Ag(s) comprise GSRAgV(s);

130. The CEPESC of aspect 129, wherein the CEPESC comprises ASFV Ag(s) that are HRSIOI to sequence(s) of 8 AAs of SEQ ID N01237 comprising AAs 382-384, 1150-1152, or both, wherein N382, N1150, or both are substituted (e.g., with a D residue);

131. The CEPESC of aspect 129, wherein ASFV Ag(s) comprise ≥8 AAs, ≥12 AAs, or ≥20 AAs of SEQ ID NO:27;

132. The CEPESC of aspect 129, wherein ASFV Ag(s) comprise ≥8 AAs, ≥12 AAs, or ≥20 AAs of SEQ ID NO:28;

133. The CEPESC of any one of aspects 124-130, wherein the CEP comprises ASFV Ag(s) comprising sequence(s) highly related, substantially identical, or identical (HRSIOI) to sequences of ≥8 AAs, ≥12 AAs, ≥20 AAs one or more of SEQ ID NOs: 238-422;

134. The CEPESC of any one of aspects 124-133, wherein ASFV Ag(s) comprise an EL WT ASFV CP204 L ORF EP, an FF, or a FV.

135. The CEPESC of any one of aspects 124-134, wherein the CEP comprises Ag(s) that are HRSIOI to a EL WT ASFV p32/p30 protein;

136. The CEPESC of any one of aspects 124-135, wherein the CEP comprises epitope(s) from or that are HRSIOI) to epitope(s) of ASFV ORF CP530R, ASFV ORF E183 L,ASFVORF EP402R, ASFV ORF B646,or CT;

137. The CEPESC of any one of aspects 124-136, wherein the CEP comprises ASFV Ag(s) that are HRSIOI) to a sequence of ≥8 AAs, ≥12 AAs, or ≥20 AAs of an EL WT ASFV p32, p54, pp62 or p72 protein;

138. The CEPESC of any one of aspects 124-137, wherein ASFV Ag(s) are encoded by a portion of SEQ ID NO: 423;

139. The CEPESC of aspect 123, wherein Ag(s) comprise, primarily comprise, is generally comprised of, is substantially comprised of, or is comprised of (CPCGCOSCOOCO) PCV Ag(s);

140. The CEPESC of aspect 139, wherein PCV Ag(s) comprise an expression product of a PCV ORF1 sequence or an antigenic variant thereof;

141. The CEPESC of aspect 139 or aspect 140, wherein at least one of the PCV Ag(s) is an EP of a PCV ORF2 sequence or a FV thereof;

142. The CEPESC of any one of aspects 139-141, wherein PCV Ags comprise expression products of at least two PCV ORFs;

143. The CEPESC of any of aspects 139-142, wherein the PCV Ags include the expression products of PCV ORFs 1 and 3;

144. The CEPESC of any of aspects 139-143, wherein the PCV Ags comprise expression products of PCV ORFs 1 and 4;

145. The CEPESC of any of aspects 139-144, wherein PCV Ags comprise expression products of PCV ORFs 2 and 3;

146. The CEPESC of any of aspects 139-145, wherein the PCV Ags comprise the expression products of PCV ORFs 2 and 4;

147. The CEPESC of any of aspects 139-146, wherein the PCV Ags comprise expression products of PCV ORFs 3 and 4;

148. The CEPESC of any one of aspects 139-147, wherein the PCV antigens comprise expression products from (a) a PCV ORF1, (b) a PCV ORF2, and (c) a PCR ORF3, a PCV ORF4, or a combination thereof;

149. The CEPESC of any one of aspects 139-148, wherein PCV Ag(s) comprise expression products of ≥1 of PCV ORF5, ORF6, ORF7, ORF8, ORF10, ORF11, and ORF12;

150. The CEPESC of any of aspects 139-149, wherein PCV Ag(s) comprise ≥8, ≥12, or ≥20 AAs of a sequence HRSIOI) to SEQ ID NO: 24;

151. The CEPESC of any one of aspects 139-150, wherein the Ag(s) comprise ≥1 of SEQ ID NOs: 143-154 or FF(s)/FV(s) thereof;

152. The CEPESC of any one of aspects 139-151, wherein PCV Ag(s) are RVRHRSIOI to one or more of SEQ ID NOs:654, 658-659, & 661-664;

153. The CEPESC of aspect 151, wherein PCV Ag(s) comprise ≥1 GSRAgV(s);

154. The CEPESC of aspect 153, wherein the PCV antigens comprise a PCV ORF2Δ143-145 sequence;

155. The composition of aspect 153, wherein the NSs encode SEQ ID NO: 25;

156. The CEPESC of aspect 152, wherein PCV Ag(s) comprise one or more of SEQ ID NOS: 655-657, 660, and 666 or FFs or FVs thereof;

157. The CEPESC of any one of aspects 139-156, wherein PCV Ag(s) comprise Ag(s) according to the formula of SEQ ID NO:667;

158. The CEPESC of any one of aspects 139-157155, wherein PCV Ag(s) comprise PCV-2d Ag(s);

159. The CEPESC of any one of aspects 139-158, wherein PCV Ag(s) comprise PCV-3 Ag(s);

160. The CEPESC of aspect 159, wherein PCV Ag(s) comprise at least 8 AAs of SEQ ID NO:155, SEQ ID NO:156, or both;

161. The CEPESC of aspect 159 or aspect 160, wherein PCV-3 Ag(s) are encoded by a portion of SEQ ID NO: 157;

162. The CEPESC of aspect 159, wherein PCV-3 Ag(s) comprise GSRAgV(s);

163. The CEPESC of aspect 162, wherein PCV-3 Ag(s) comprise at least 8 AAs of SEQ ID NO:439, comprising residues 16-18 thereof; at least 8 AAs of SEQ ID NO:440 comprising residues 124-126 thereof; or a portion of SEQ ID NO:441 comprising AAs 16-126 thereof;

164. The CEPESC of aspect 123, wherein Ag(s) CPCGCOSCOOCO PRRSV Ag(s);

165. The CEPESC of aspect 164, where PRRSV Ag(s) comprise ORF3 Ag(s);

166. The CEPESC of aspect 164 or aspect 165, wherein PRRSV Ag(s) comprise PRRSV GP3 sequence(s);

167. The CEPESC of any one of aspects 164-166, wherein PRRSV Ag(s) comprise PRRSV ORF1a Ag(s);

168. The CEPESC of any one of aspects 164-167, wherein PRRSV Ag(s) comprise PRRSV nsp7 sequence(s);

169. The CEPESC of any one of aspects 164-168, wherein PRRSV Ag(s) comprise PRRSV nsp7 sequence(s);

170. The CEPESC of any one of aspects 164-169, wherein PRRSV Ag(s) comprise PRRSV nsp7 sequence(s);

171. The CEPESC of any one of aspects 164-170, wherein PRRSV Ag(s) comprise PRRSV ORF7 Ag(s);

172. The CEPESC of any one of aspects 164-171, wherein PRRSV Ag(s) comprise PRRSV protein N sequence(s);

173. The CEPESC of any one of aspects 164-172, wherein PRRSV Ag(s) comprise PRRSV envelope glycoprotein GP2 (ORF2) Ag(s);

174. The CEPESC of any one of aspects 164-173, wherein PRRSV Ag(s) comprise PRRSV envelope glycoprotein GP4 (ORF4) Ag(s);

175. The CEPESC of any one of aspects 164-174, wherein PRRSV Ag(s) comprise PRRSV nucleocapsid protein ORF7;

176. The CEPESC of any one of aspects 164-175, wherein PRRSV Ag(s) comprise PRRSV ORF1a' sequence(s), PRRSV ORF1b sequence(s), PRRSV ORF2a sequence(s), PRRSV ORF2b sequence(s), PRRSV ORF4 sequence(s), PRRSV ORF5 sequence(s), PRRSV ORF5a sequence(s), PRRSV ORF6 sequence(s), or CT;

177. The CEPESC of any one of aspects 164-176, wherein PRRSV Ag(s) comprise Ag(s) of AAs 1-100 of a PRRSV ORF3 sequence;

178. The CEPESC of any one of aspects 164-177, wherein PRRSV Ag(s) comprise PRRSV NSP1α sequence(s) or NSP1P sequence(s);

179. The CEPESC of any one of aspects 164-178, wherein PRRSV Ag(s) comprise PRRSV NSP2 sequence(s);

180. The CEPESC of any one of aspects 164-179, wherein PRRSV Ag(s) comprise PRRSV NSP3 sequence(s);

181. The CEPESC of any one of aspects 164-167, wherein PRRSV Ag(s) comprise PRRSV NSP4 sequence(s), NSP5 sequence(s), NSP7a sequence(s), NSP7β sequence(s), NSP8 sequence(s), NSP9 sequence(s), NSP10 sequence(s), NSP11 sequence(s), NSP12 sequence(s), or CT;

182. The CEPESC of any one of aspects 164-167, wherein PRRSV Ag(s) comprise 1+ of SEQ ID NOs: 120-132 or FF/FV(s) thereof;

183. The CEPESC of any one of aspects 164-182 wherein the PRRSV Ag(s) comprise ≥8, ≥12, ≥20 AAs of SEQ ID NO:11 or a FV thereof;

184. The CEPESC of any of aspects 164-183, wherein the PRRSV Ag(s) comprise GSRAgV(s);

185. The CEPESC of any one of aspects 184, wherein the PRRSV Ag(s) comprise ≥8, ≥12, ≥20 AAs of SEQ ID NO:12 or a FV thereof;

186. The CEPESC of any one of aspect 185 wherein the PRRSV Ag(s) comprise ≥8, ≥12, ≥20 AAs of SEQ ID NO:13 or a FV thereof;

187. The CEPESC of aspect 184, where the PRRSV Ag(s) comprise sequence(s) of ≥8, ≥12, ≥20 AAs of a sequence according to the formula (SEQ ID NO: 424)
MVNSCTFLHIFLCCSFLYSFCCAVVAGSX1TTYCFWFPLVRGX2FSFELTV

X3YTVCPPCLTRQAATEIYEPGRSLWCRIGYDRCGEDDHDELGFMIPPGLS

SEGHLTSVYAWLAFLSFSYTAQFHPEIFGIGX4VSRVYVDIKHQLICAEHD

GQX5TTLPRHDX6ISAVFQTYYQHQVDGGNWFHLEWLRPFFSSWLVLX7VS

WFLRRSPANHVSVRVLQILRPTPPQRQALLSSKTSVALGIATRPLRRFAKS

LSAVRR, wherein X1-X7 are D/N, ≥1 of X1-X7 are D, less than all of X1-X7 are D, and Ag(s) comprise ≥1 of any of X1-X7 or CT, or a FV;

188. The CEPESC of aspect 184, wherein the PRRSV Ag(s) comprise ≥8, ≥12, ≥20 AAs of a sequence according to the formula (SEQ ID NO: 426)
SLCQVIEDCCCSQX1KTNRVTPEEVAAKIDLYLRGATNLEECLARLEKARP

PRVIDTSFDWDVVLPGVEAATQTIKLPQVNQCRALVPVVTQKSLDX2NSVP

LTAFSLANYYYRAQGDEVRHRERLTAVLSKLEKVVREEYGLMPTEPGPRPT

LPRGLDELKDQMEEDLLKLANAQTTSDMMAWAVEQVDLKTWVKNYPRWTPP

PPPPKVQPRKTKPVKSLPERKPVPAPRRKVGSDCGSPVSLGGDVPNSWEDL

AVSSPFDLPTPPEPATPSSELVIVSSPQCIFRPATPLSEPAPIPAPRGTVS

RPVTPLSEPIPVPAPRRKFQQVKRLSSAAAIPPYQDEPLDLSASSQTEYEA

SPPAPPQSGGVLGVEGHEAEETLSEISDMSGNIKPASVSSSSSLSSVRITR

PKYSAQAIIDSGGPCSGHLQEVKETCLSVMREACDATKLDDPATQEWLSRM

WDRVDMLTWRX3TS, wherein X1-X3 are D or N and ≥1 of X1-X3 are D, or a FV;

189. The CEPESC of aspect 184, wherein the CEPESC comprises at least a portion of SEQ ID NO: 427 comprising AAs 51-53 thereof;

190. The CEPESC of aspect 184, wherein the PRRSV Ag(s) comprise ≥8, ≥12, ≥20 AAs of a sequence according to the formula (SEQ ID NO: 428)
X1RTFTLGPVNLKVASEVELKDAVEHNQHPVARPIDGGVVLLRSAVPSLID

VLISGADASPKLLAHHGPGNTGIDGTLWDFESEATKEEVALSAQIIQACDI

RRGDAPEIGLPYKLYPVRGNPERVKGVLQNTRFGDIPYKTPSDTGSPVHAA

ACLTPX2ATPVTDGRSVLATTMPPGFELYVPTIPASVLDYLDSRPDCPKQL

TEHGCEDAALKDLSKYDLSTQGFVLPGVLRLVRKYLFAHVGKCPPVHRPST

YPAKNSMAGINGNRFPTKDIQSVPEIDVLCAQAVRENWQTVTPCTLKKQYC

GKKKTRTILGTNNFIALAHRAVLSGVTQGFMKKAFNSPIALGKNKFKELQT

PVLGRCLEADLASCDRSTPAIVRWFAANLLYELACAEEHLPSYVLNCCHDL

LVTQSGAVTKRGGLSSGDPITSVSNTIYSLVIYAQHMVLSYFKSGHPHGLL

FLQDQLKFEDMLKVQPLIVYSDDLVLYAESPTMPNYHWWVEHLNLMLGFQT

DPKKTAITDSPSFLGCRIINGRQLVPNRDRILAALAYHMKASX3VS, wherein X1-X3 are D or N and ≥1 of X1-X3 are D, or a FV;

191. The CEPESC of aspect 184, wherein the CEPESC comprises at least a portion of SEQ ID NO: 429 comprising AAs 300-302 thereof;

192. The CEPESC of aspect 184, wherein the CEPESC comprises at least a portion of SEQ ID NO: 430 comprising AAs 21-23 thereof;

193. The CEPESC of aspect 184, wherein the PRRSV Ag(s) comprise ≥8, ≥12, ≥20 AAs of a sequence according to the formula (SEQ ID NO: 431)
X1TSPLADKEEKIFRFGSHKWYGAGKRARKARSCATATVAGRALSVRETRQ

AKEHEVAGANKAEHLKHYSPPAEGNCGWHCISAIANRMVNSKFETTLPERV

RPPDDWATDEDLVNAIQILRLPAALDRNGACTSAKYVLKLEGEHWTVTVTP

GMSPSLLPLECVQGCCGHKGGLGSPDAVEVSGFDPACLDRLAEVMHLPSSA

IPAALAEMSGDSDRSASPVTTVWTVSQFFARHSGGNHPDQVRLGKIISLCQ

VIEDCCCSQX2KTNRVTPEEVAAKIDLYLRGATNLEECLARLEKARPPRVI

DTSFDWDVVLPGVEAATQTIKLPQVNQCRALVPVVTQKSLDX3NSVPLTAF

SLANYYYRAQGDEVRHRERLTAVLSKLEKVVREEYGLMPTEPGPRPTLPRG

LDELKDQMEEDLLKLANAQTTSDMMAWAVEQVDLKTWVKNYPRWTPPPPPP

KVQPRKTKPVKSLPERKPVPAPRRKVGSDCGSPVSLGGDVPNSWEDLAVSS

PFDLPTPPEPATPSSELVIVSSPQCIFRPATPLSEPAPIPAPRGTVSRPVT

PLSEPIPVPAPRRKFQQVKRLSSAAAIPPYQDEPLDLSASSQTEYEASPPA

PPQSGGVLGVEGHEAEETLSEISDMSGNIKPASVSSSSSLSSVRITRPKYS

AQAIIDSGGPCSGHLQEVKETCLSVMREACDATKLDDPATQEWLSRMWDRV

DMLTWRX4TSVYQAICTLDGRLKFLPKMILETPPPYPCEFVMMPHTPAPSV

GAESDLTIGSVATEDVPRILEKIENVGEMANQGPLAFSEDKPVDDQLVNDP

RISSRRPDESTSAPSAGTGGAGSFTDLPPSDGADADGGGPFRTVKRKAERL

FDQLSRQVFDLVSHLPVFFSRLFYPGGGYSPGDWGFAAFTLLCLFLCYSYP

AFGIAPLLGVFSGSSRRVRMGVFGCWLAFAVGLFKPVSDPVGAACEFDSPE

CRNILHSFELLKPWDPVRSLVVGPVGLGLAILGRLLGGARCIWHFLLRLGI

VADCILAGAYVLSQGRCKKCWGSCIRTAPNEVAFNVFPFTRATRSSLIDLC

-continued

```
DRFCAPKGMDPIFLATGWRGCWAGRSPIEQPSEKPIAFAQLDEKKITARTV
VAQPYDPNQAVKCLRVLQAGGAMVAKAVPKVVKVSAVPFRAPFFPTGVKVD
PDCRVVVDPDTFTAALRSGYSTTNLVLGVGDFAQLNGLKIRQISKPSGGGP
HLMAALHVACSMALHMLAGIYVTAVGSCGTGTNDPWCANPFAVPGYGPSL
CTSRLCISQHGLTLPLTALVAGFGIQEIALVVLIFVSIGGMAHRLSCKADM
LCVLLAIASYVWVPLTWLLCVFPCWLRCFSLHPLTILWLVFFLISVNMPSG
ILAMVLLVSLWLLGRYTNVAGLVTPYDIHHYTSGPRGVAALAIAPDGTYLA
AVRRAALTGRTMLFTPSQLGSLLEGAFRTRKPSLNTVNVIGSSMGSGGVFT
IDGKVKCVTAAHVLTGNSARVSGVGFNQMLDFDVKGDFAIADCPNWQGAAP
KTQFCTDGWTGRAYWLTSSGVEPGVIGKGFAFCFTACGDSGSPVITEAGEL
VGVHTGSNKQGGGIVTRPSGQFCNVAPIKLSELSEFFAGPKVPLGDVKVGS
HIIKDISEVPSDLCALLAAKPELEGGLSTVQLLCVFFLLWRMMGHAWTPLV
AVSFFILNEVLPAVLVRSVFSFGMFVLSWLTPWSAQVLMIRLLTAALNRNR
WSLAFFSLGAVTGFVADLAATQGHPLQAVMX5LSTYAFLPRMMVVTSPVPV
ITCGVVHLLAIILYLFKYRGPHHILVGDGVFSAAFFLRYFAEGKLREGVSQ
SCGMNHESLTGALAMRLNDEDLDFLMKWTNFKCFVSASNMRNAAGQFIEAA
YAKALRVELAQLVQVDKVRGTLAKLEAFADTVAPQLSPGDIVVALGHTPVG
SIFDLKVGSTKHTLQAIETRVLAGSKMTVARVVDPTPTPPPAPVPIPLPPK
VLENGPNAWGDEDRLNKKKRRRMEALGIYVMGGKKYQKFWDKNSGDVFYEE
VHX6NT,
``` wherein X1-X6 are D or N and at least 1 of X1-X6 are D, or a FV;

194. The CEPESC of aspect 184, wherein the PRRSV Ag(s) comprise ≥8, ≥12, ≥20 AAs of a sequence according to the formula (SEQ ID NO: 431)
```
X1RTFTLGPVNLKVASEVELKDAVEHNQHPVARPIDGGVVLLRSAVPSLID
VLISGADASPKLLAHHGPGNTGIDGTLWDFESEATKEEVALSAQIIQACDI
RRGDAPEIGLPYKLYPVRGNPERVKGVLQNTRFGDIPYKTPSDTGSPVHAA
ACLTPTDGRSVLATTMPPGFELYVPTIPASVLDYLDSRPDCPKQLTEHGCE
DAALKDLSKYDLSTQGFVLPGVLRLVRKYLFAHVGKCPPVHRPSTYPAKNS
MAGINGNRFPTKDIQSVPEIDVLCAQAVRENWQTVTPCTLKKQYCGKKKTR
TILGTNNFIALAHRAVLSGVTQGFMKKAFNSPIALGKNKFKELQTPVLGRC
LEADLASCDRSTPAIVRWFAANLLYELACAEEHLPSYVLNCCHDLLVTQSG
AVTKRGGLSSGDPITSVSNTIYSLVIYAQHMVLSYFKSGHPHGLLFLQDQL
KFEDMLKVQPLIVYSDDLVLYAESPTMPNYHWWVEHLNLMLGFQTDPKKTA
ITDSPSFLGCRIINGRQLVPNRDRILAALAYHMKASX2VSEYYASAAAILM
DSCACLEYDPEWFEELVVGIAQCARKDGYSFPGTPFFMSMWEKLRSNYEGK
KSRVCGYCGAPAPYATACGLDVCIYHTHFHQHCPVTIWCGHPAGSGSCSEC
KSPVGKGTSPLDEVLEQVPYKPPRTVIMHVEQGLTPLDPGRYQTRRGLVSV
RRGIRGNEVELPDGDYASTALLPTCKEINMVAVASNVLRSRFIIGPPGAGK
TYWLLQQVQDGDVIYTPTHQTMLDMIRALGTCRFNVPAGTTLQFPVPSRTG
```

-continued
```
PWVRILAGGWCPGKNSFLDEAAYCNHLDVLRLLSKTTLTCLGDFKQLHPVG
FDSHCYVFDIMPQTQLKTIWRFGQNICDAIQPDYRDKLMSMVX3TTRVTYV
EKPVRYGQVLTPYHRDREDDAITIDSSQGATFDVVTLHLPTKDSLNRQRAL
VAITRARHAIFVYDPHRQLQGLFDLPAKGTPVNLAVHRDGQLIVLDRNNKE
CTVAQALGNGDKFRATDKRVVDSLRAICADLEGSSSPLPKVAHNLGFYFSP
DLTQFAKLPVELAPHWPVVTTQNNEKWPDRLVASLRPIHKYSRACIGAGYM
VGPSVFLGTPGVVSYYLTKFVKGEAQVLPETVFSTGRIEVDCREYLDDRER
EVAASLPHAFIGDVKGTTVGGCHHVTSRYLPRVLPKESVAVVGVSSPGKAA
KALCTLTDVYLPDLEAYLHPETQSKCWKMMLDFKEVRLMVWKDKTAYFQLE
GRYFTWYQLASYASYIRVPVX4ST,
``` wherein X1-X4 are D or N and at least one of X1-X4 are D, or a FV;

195. The CEPESC of aspect 184, wherein the PRRSV Ag(s) comprise ≥8, ≥12, ≥20 AAs of a sequence according to the formula (SEQ ID NO: 433)
```
VVAHFQHLAAIEAETCKYLASRLPMLHNLRMTGSX1VTIVYX2STLNQVFA
IFPTPGSRPKLHDFQQWLIAVHSSIFSSVAASCTLFVVLWLRVPILRTVFG
FRWLGAIFLSNSQ,
``` wherein X1 & X2 are D or N, and at least one of X1 & X2 are D, or a FV;

196. The CEPESC of aspect 184, wherein PRRSV Ag(s) comprise ≥8, ≥12, or ≥20 AAs of a sequence according to the formula (SEQ ID NO: 434)
```
MVNSCTFLHIFLCCSFLYSFCCAVVAGSX1TTYCFWFPLVRGX2FSFELTV
X3YTVCPPCLTRQAATEIYEPGRSLWCRIGYDRCGEDDHDELGFMIPPGLS
SEGHLTSVYAWLAFLSFSYTAQFHPEIFGIGX4VSRVYVDIKHQLICAEHD
GQX5TTLPRHDX6ISAVFQTYYQHQVDGGNWFHLEWLRPPFFSSWLVLX7VS
WFLRRSPANHVSVRVLQILRPTPPQRQALLSSKTSVALGIATRPLRRFAKS
LSAVRR,
``` where X1-X7 are D/N and 1+ of X1-X7 is D, or a FV;

197. The CEPESC of aspect 184, wherein the PRRSV Ag(s) comprise a sequence of at least 8 AAs and including 1+ of X1-X4 of the formula (SEQ ID NO: 435)
```
MASSLLFLVVGFKCLLVSQAFACKPCFSSSLADIKTX1TTAAASFAVLQDI
SCLRHRDSASEAIRKIPQCRTAIGTPVYVTITAX2VTDENYLHSSDLLMLS
SCLFYASEMSEKGFKVVFGX3VSGIVAVCVX4FTSYVQHVKEFTQRSLVVD
HVRLLHFMTPETMRWATVLACLFAILLAI,
``` wherein X1-X4 are D or N, at least one of X1-X4 is D;

198. The CEPESC of aspect 184, wherein the PRRSV Ag(s) comprise a sequence of at least 8 AAs and including 1+ of X1-X4 of the formula (SEQ ID NO: 436)
MLEKCLTAGCCSRLLSLWCIVPFCFAVLAX1ASX2DSSSHLQLIYX3LTLC

ELX4GTDWLANKFDWAVESFVIF, wherein X1-X4 are D or N, ≥1 of X1-X4 is D, or a FV;
199. The CEPESC of aspect 184, wherein the PRRSV Ag(s) comprise ≥8 AAs or ≥20 AAs of SEQ ID NO:437 comprising AAs 144-146 thereof;
200. The CEPESC of aspect 184, wherein the PRRSV Ag(s) comprise ≥8 or ≥20 AAs of SEQ ID NO:438 comprising AAs 34-36 thereof;
201. The CEPESC of aspect 123, wherein the pathogen Ag(s) comprises, primarily comprises, is generally comprised of, is substantially comprised of, or is comprised of (CPCGCOSCOOCO) EHV Ag(s);
202. The CEPESC of aspect 201, wherein the EHV Ag(s) comprise EHV1 Ag(s);
203. The CEPESC of aspect 201 or aspect 202, wherein the EHV Ag(s) comprise EHV immediate early gene ICP4 epitope(s);
204. The CEPESC of aspects 201-203, wherein the EHV Ag(s) comprise EHV Tegument Protein a-TIF epitope(s);
205. The CEPESC of aspect 204, wherein the EHV Ag(s) comprise sequences of one or more of EHV Tegument Protein a-TIF portions ICP0, ICP22, and ICP2;
206. The CEPESC of aspects 201-205, wherein EHV Ag(s) comprise sequence(s) of at least 8 AAs of one of SEQ ID NOs: 158-237;
207. The CEPESC of aspects 201-206, wherein EHV Ag(s) comprise GSRAgV(s) comprising GSRV(s) in one or more of SEQ ID NOs: 159-160, 162-164, 166, 168-175, 178-181, 185, 187, 189-190, 194, 196, 198-200, 202-203, 206-207, 210-214, 218, 221, 224-225, 227-231, 233, and 234;
208. The CEPESC of aspects 201-206, wherein the EHV Ag(s) comprise at least 8 AAs of one of SEQ ID NOs: 442-449;
209. The CEPESC of aspect 123, wherein the pathogen Ag(s) CPCGCOSCOOCO) coronavirus (COV) Ag(s);
210. The CEPESC of aspect 209, wherein COV Ag(s) are SARS-COV2 Ag(s);
211. The CEPESC of aspect 210, wherein COV Ag(s) comprise SARS-COV2 S protein Ag(s) or HR or SI FV(s) thereof;
212. The CEPESC of any one of aspects 209-211, wherein COV Ag(s) comprise ≥8, ≥12, or ≥20 AAs of SEQ ID NO: 14 or a FV thereof;
213. The CEPESC of aspects 209-212, wherein COV Ag(s) comprise ≥8, ≥12, ≥20 AAs of a sequence according to the formula (SEQ ID NO: 20)
MFVFLVLLPLVSSQCVX$_1$LTTRTQLPPAYTNSFTRGVYYPDKVFRSSVLHS

TQDLFLPFFSX$_2$VTWFHAIHSGTX$_3$GTKRFDNPVLPFNDGVYFASTEKSNI

IRGWIFGTTLDSKTQSLLIVNX$_4$ATNVVIKVCEFQFCNDPFLGVYYHKN

X$_5$KSWMESEFRVYSSANX$_5$CTFEYVSQPFLMDLEGKQGNFKNLREFVFKNI

DGYFKIYSKHTPINLVRDLPQGFSALEPLVDLPIGIX$_6$ITRFQTLLALHR

SYLTPGDSSSGWTAGAAAYYVGYLQPRTFLLKYNEX$_7$GTITDAVDCALDP

LSETKCTLKSFTVEKGIYQTSNFRVQPTESIVRFPX$_8$ITNLCPFGEVFX$_9$

ATRFASVYAWNRKRISNCVADYSVLYNSASFSTFKCYGVSPTKLNDLCFT

-continued
NVYADSFVIRGDEVRQIAPGQTGKIADYNYKLPDDFTGCVIAWNSNNLDS

KVGGNYNYLYRLFRKSNLKPFERDISTEIYQAGSTPCNGVEGFNCYFPLQ

SYGFQPTNGVGYQPYRVVVLSFELLHAPATVCGPKKSTNLVKNKCVNFNF

NGLTGTGVLTESNKKFLPFQQFGRDIADTTDAVRDPQTLEILDITPCSFG

GVSVITPGTX$_{10}$TSNQVAVLYQDVX$_{11}$CTEVPVAIHADQLTPTWRVYSTGS

NVFQTRAGCLIGAEHVX$_{12}$NSYECDIPIGAGICA5YQTQTN5PRRARSVA

SQSIIAYTMSLGAENSVAYSX$_{13}$NSIAIPTX$_{14}$FTISVTTEILPVSMTKTS

VDCTMYICGDSTECSNLLLQYGSFCTQLNRALTGIAVEQDKNTQEVFAQ

VKQIYKTPPIKDFGGFX$_{15}$FSQILPDPSKPSKRSFIEDLLFNKVTLADAG

FIKQYGDCLGDIAARDLICAQKFNGLTVLPPLLTDEMIAQYTSALLAGT

ITSGWTFGAGAALQIPFAMQMAYRFNGIGVTQNVLYENQKLIANQFNSA

IGKIQDSLSSTASALGKLQDVVNQNAQALNTLVKQLSSNFGAISSVLND

ILSRLDKVEAEVQIDRLITGRLQSLQTYVTQQLIRAAEIRASANLAATK

MSECVLGQSKRVDFCGKGYHLMSFPQSAPHGVVFLHVTYVPAQEKX$_{16}$FT

TAPAICHDGKAHFPREGVFVSX$_{17}$GTHWFVTQRNFYEPQIITTDNTFVSG

NCDVVIGIVX$_{18}$X$_{19}$TVYDPLQPELDSFKEELDKYFKX$_{20}$HTSPDVDLGDIS

GIX$_{21}$ASVVNIQKEIDRLNEVAKNLX$_{22}$ESLIDLQELGKYEQYIKWPWYIW

LGFIAGLIAIVMVTIMLCCMTSCCSCLKGCCSCGSCCKFDEDDSEPVLK

GVKLHYT, wherein X is D or N, and at least one of X$_1$-X$_{22}$ is a D (Formula I, SEQ ID NO:744);
214. The CEPESC of aspect 213, wherein the COV Ag(s) comprise at least one of X$_1$-X$_{22}$ and 1+D substitution of a corresponding N residue in SEQ ID NO: 14;
215. The CEPESC of any of aspects 209-214, wherein COV Ag(s) comprise a sequence of a SARS-COV2 N protein or a FV thereof;
216. The CEPESC of any of aspects 209-215, wherein COV Ag(s) comprise ≥8, ≥12, or ≥20 AAs of SEQ ID NO: 15 or a FV thereof;
217. The CEPESC of any of aspects 204-210, wherein COV Ag(s) comprise sequence(s) of ≥8, ≥12, or ≥20 AAs of the formula (SEQ ID NO: 21)
MSDNGPQNQRNAPRITFGGPSDSTGSNQNGERSGARSKQRRPQGLPX$_1$X$_2$T

ASWFTALTQHGKEDLKFPRGQGVPINTX$_3$SSPDDQIGYYRRATRRIRGGDG

KMKDLSPRWYFYYLGTGPEAGLPYGANKDGIIWVATEGALNTPKDHIGTR

NPANNAAIVLQLPQGTTLPKGFYAEGSRGGSQASSRSSSRSRX$_4$SSRX$_5$ST

PGSSRGTSPARMAGNGGDAALALLLLDRLNQLESKMSGKGQQQQGQTVTK

KSAAEASKKPRQKRTATKAYX$_6$VTQAFGRRGPEQTQGNFGDQELIRQGTD

YKHWPQIAQFAPSASAFFGMSRIGMEVTPSGTWLTYTGAIKLDDKDPNF

KDQVILLNKHIDAYKTFPPTEPKKDKKKKADETQALPQRQKKQQTVTLL

PAADLDDFSKQLQQSMSSADSTQA, where X is D or N, and ≥1 of X$_1$-X$_6$ is a D;
218. The CEPESC of aspect 217, wherein COV Ag(s) comprise ≥8, ≥12, or ≥20 AAs of SEQ ID NO: 21 and comprise ≥1 of X$_1$-X$_6$ and at least one Asp substitution of a corresponding Asn residue in SEQ ID NO: 15;

219. The CEPESC of any one of aspects 209-218, wherein COV Ag(s) comprise SARS-COV2 M protein sequence(s) or FV(s) thereof;
220. The CEPESC of any of aspects 209-219, wherein COV Ag(s) comprise ≥8, ≥12, or ≥20 AAs of SEQ ID NO:16 or a HR or SI FV;
221. The CEPESC of any one of aspects 209-220, wherein COV Ag(s) comprise ≥8, ≥12, or ≥20 AAs of SEQ ID NO: 22 or a HR or SI FV thereof.
222. The CEPESC of any one of aspects 209-221, wherein COV Ag(s) comprise SARS-COV2 E protein sequence(s) or FV(s) thereof;
223. The CEPESC of aspect 122, wherein the cancer Ag(s) PCGCOSCO or CO transitional cell carcinoma Ag(s), bladder cancer Ag(s), or both;
224. The CEPESC of aspect 222, wherein cancer Ag(s) comprise B-RAF Ag(s);
225. The CEPESC of aspect 224, wherein the cancer Ag(s) comprise ≥8, ≥12, or ≥20 AAs of one of SEQ ID NOs: 450-453 or a FV thereof;
226. The CEPESC of any one of aspects 222-225, wherein cancer Ag(s) comprise MAGE-3 Ag(s);
227. The CEPESC of aspect 226, wherein cancer Ag(s) comprise ≥8, ≥12, or ≥20 AAs of SEQ ID NO:454 or a FV thereof;
228. The CEPESC of any one of aspects 222-227, wherein cancer Ag(s) comprise NY-ESO-1 Ag(s);
229. The CEPESC of aspect 228, wherein cancer Ag(s) comprise ≥8, ≥12, or ≥20 AAs of SEQ ID NO:455 or a FV thereof;
230. The CEPESC of any one of aspects 222-229, wherein cancer Ag(s) comprise Her-2 Ag(s);
231. The CEPESC of aspect 230, wherein cancer Ag(s) comprise ≥8, ≥12, or ≥20 AAs of SEQ ID NO:456 or a FV thereof;
232. A CEPESC according to any one of aspects 1-231, wherein the composition is a dried composition that is reconstitute-able and shelf stable for a period of at least one year at room temperature (or ordinary environmental temperatures) and typical humidity conditions;
233. A CEPESC according to any one of aspects 1-121 and 123-222, wherein the CEPESC comprises anti-pathogen composition(s);
234. A CEPESC according to any one of aspects 1-121, 124, and 222-231, wherein the CEPESC comprises anti-cancer composition(s);
235. A CEPESC according to any one of aspects 1-234, wherein the CEPESC comprises adjuvant(s);
236. A CEPESC according to any one of aspects 40-52, wherein the CEPESC induces significantly enhanced IR(s) as compared to a corresponding construct according to the Wistar Art;
237. A method of inducing DOS IR(s) in TR(s) comprising administering EA(s) of CEPESC(s) according to any one of aspects 1-236 to the TR(s);
238. The method of aspect 237, wherein the method comprises delivering EA(s) of composition(s) according to any one of aspects 1-236 to the TR(s) two or more times;
239. A method of inducing DOS IR(s) in TR(s) comprising administering EA(s) of CEPESC(s) according to any one of aspects 122 and 222-231 to TR(s) diagnosed with cancer or a precancerous condition;
240. The method of aspect 239, wherein the method comprises administering a CCC or AAC comprising an anti-cancer compound to the TR;
241. A method of inducing IR(s) against a pathogen comprising delivering EA(s) of CEPESCs of any one of aspects 123-222 to TR(s) to immunize the TR(s) against the pathogens;
242. A method of inducing IR(s) against a pathogen comprising delivering EA(s) of CEPESCs of any one of aspects 123-222 to TR(s) to treat the TR(s) against an infection with the pathogen;
243. The method of aspect 241 or aspect 242, wherein the pathogen is a leaky vaccine associated pathogen;
244. The method of any one of aspects 241-243, wherein the method comprises administering an anti-pathogen CCC or AAC to the TR(s);
245. The method of any one of aspects 237-244243, wherein the TR(s) are non-HVEM-expressing TR(s);
246. The method of any one of aspects 241-245, where TR(s) are NDISTR(s);
247. The method of any of aspects 237-243 & 246, where TR(s) are humans;
248. The method of any one of aspects 237-247, wherein the TR is a companion animal or livestock animal;
249. The method of aspect 248, wherein the TR is a cat, a dog, or a horse;
250. The method of aspect 248, wherein the subject is a bird;
251. The method of aspect 248, wherein the subject is an even toed ungulate;
252. The method of aspect 251, wherein the subject is a pig;
253. The method of any one of aspects 237-252, wherein the method comprises (a) delivering an EA of a first dose of a CEPESC to a TR; monitoring the TR(s) for (i) inducement of CSAE(s) in response to delivery of the $1^{st}$ composition, (ii) inducement of VAERD in response to delivery of the $1^{st}$composition, (iii) inducement of an immunogenic adverse reaction to the $1^{st}$composition, (iv) development of immunological tolerance to Ag(s) of the $1^{st}$composition, or (v) a combination of any or all of (i)-(iv); and (c) if any of the conditions in (b) is detected (or detected in an amount meeting standard(s)) adjusting the treatment regimen by changing the frequency of CEPESC delivery, dosage of additional CEPESC(s), composition of additional CEPESC(s), or delivery of other compounds or performance of other methods to the TR(s);
254. A method of developing a medicament comprising (a) identifying PCRA(s), (b) delivering the PCRA(s) to IC(s) of TR(s), (c) assessing IR(s) induced by the PCRA(s), (d) selecting CRA(s) that induce IR(s) at or above a standard in the ICs; (e) obtaining NSs encoding the CRA(s); and (f) developing a construct comprising the CRAES(s) and gDPES(s);
255. The method of aspect 254, wherein step (b) comprises administering a construct comprising putative clinically relevant antigen encoding sequence(s) (PCRAES(s)) and gDPES(s) to the ICs;
256. The method of aspect 254 or 255, wherein the ICs are in TR(s);
257. The method of any one of aspects 254-256, wherein PCRAES(s) encode variant(s) of a wild-type PCRA from which one or more B cell epitopes have been removed, one or more glycosylation sites have been removed, or both, and the standard comprises a lower likelihood, severity, or duration of a cytokine storm in the test subjects, a reduced likelihood of occurrence, reduced severity, or reduced duration of VAERD in the subjects, or both;
258. The method of any one of aspects 254-257, wherein putative clinically relevant antigen(s) (PCRA(s)) comprise predicted MHC I epitope(s) and predicted MHC II epitope(s) and the standard comprises achieving a statistically significant CTL response, a statistically significant TH cell response, and a statistically significant humoral response;

259. The method of any one of aspects 254-258, wherein the method comprises repeatedly administering the same composition administered in step (b) one or more times before evaluating whether the putative antigen is a clinically relevant antigen;

260. A composition comprising (i) one or more nucleic acid molecules that comprise a sequence encoding a fusion protein comprising (a) at least one receptor-binding gD domain, (b) at least one antigenic sequence, and (c) at least two additional antigenic sequences, wherein the at least three antigenic sequences primarily induce immune responses in three different immune cell types, at least one PTPS associated with at least one antigenic sequence, at least one expression-enhancing intron associated with at least one coding sequence, at least one ITII, or a combination of any or all thereof and (ii) means for causing expression of the fusion-protein sequence, and (iii) means for promoting cellular uptake of the nucleic acid molecule(s);

261. The composition of aspect 260, wherein the composition further comprises (iv) means for administering the composition to a subject;

262. A method of promoting, inducing, or enhancing an immune response in an alphaherpesvirus infectable vertebrate animal subject by administering an effective amount of a compound of aspect 260 or aspect 261 to the subject, the method comprising a step for administering the composition to the subject;

263. The method of aspect 262, wherein TR(s) are diagnosed with a cancer and the method comprises employing an additional step for treating cancer; and 264. The method of aspect 262, wherein the method is used to treat or prevent a pathogenic infection and the method comprises employing an additional step for pathogenic infection prevention or treatment.

---

SEQUENCE LISTING (755 sequences)

SEQ ID NO: 1 - protein, 75 aa, Homo sapiens
MQIFVKTLTGKTITLEVEPSDTIENVKAKIQDKEGIPPDQQRLIFAGKQLEDGRTLSDYNIQKESTLHLVLRLRG

SEQ ID NO: 2 - DNA, 6153 bp, Artificial Sequence
  SYNTHETIC CONSTRUCT DERIVED FROM HUMAN THOUGHT
cctgcaggtcgacaatattggctattggccattgcatacgttgtatctatatcataatatgtacatttatattggctcatgtccaatatgaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagctcggagattgggctcgcaccgctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccaagcttggatccgctagcgccaccatgcagatcttcgtgaagaccctgaccggcaagaccatcaccctggaggtggagcccagtgacaccatcgagaatgtgaaggccaagatccaggataaggagggcattccccccgaccagcagaggctcatctttgcaggcaagcagctggaggatggccgcactctttctgattacaacatccagaaagagtccaccctccatctggttctgcgtctgaggggtgcggccgcagattttattttaaatatatccatgaaaatggaggtcatcttcaaaacggatttaagatcatcttcacaagttgtgtttcatgcgggtagcctgtataattggttttctgttgagattatcaatagcggtagaattgttacgaccgctataaaaacattgcttagtactgttaagtatgatattgtgaaatctgctcgtatatatgcagggcaagggtatactgaacatcaggctcaagaagaatggaatatgattctgcatgtgctgtttgaagaggagacggaatcctcagcatcttcggagaacattcatgaaaaaaatgataatgaaaccaatgaatgcacatcctcctttgaaacgttgtttgagcaagagccctcatcggaggtacctaaagactccaagctgtatatgcttgcacaaaagactgtgcaacatattgaacaatatggaaaggcacctgattttaacaaggttattagagcacataattttattcaaaccatttatggaacccctctaaaggaagaagaaaaagaggtggtaagactcatggttattaaacttttaaaaaaaataagcttttatctcacctacattaccggttccggcgagggcaggggaagtcttctaacatgcggggacgtggaggaaaatcccggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaactcgaggtttaaacgaattctgcagatatccagcacagtggtcgaggggcccggagatctacgtatgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgacagctcgactctagaattgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattaattaattatttcagttcgagttcgttcattgcagcaatgctgaaaccgccgtcaacgtggaccacttcaccggagataccggcagagagatcggagcacaggaatgccgcagagttacccacatcttcaatagtaacggtacggcgaatcggggtaacggcttcgcaatgagccagcattttgcggaagtctttgataccggaggccgccagagtacggatcggaccagcagagatggcgttaacacgcacaccttccggacccatcgcgttcgccatatagcgcacgttcgcttccagagacgcttttgccagacccataacgttgtagttcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgggtaacggcgttaacatagtcaccatccagctgatcgccaggtgcaaaaccaatagagtgtacgaaaccgtcaaatttcggccaaactttccccagttcagcgaacatggtgtcgatgctggcatcttctgcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggatagtttgctggcaacgccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgagtagctatagttgccaggtccgaccggagcaggctgcggcagggggggcgcttttcccctcaccctaaccctctccccagaggggcgaggggaccgtattgtgcaaatattgttaccccagcaacaaacaggctcatacagcccctaaccctttcatggcgatggctgggacggttcagaccttgccgaatattctccagcacaatattattgaagcatttatcagggttattgtcggcgcgcctcagagattttgagacacaacgtggctttccccccccccccggcatg

SEQ ID NO: 3 - DNA, 6223 bp, Artificial Sequence
  SYNTHETIC CONSTRUCT DERIVED FROM HUMAN THOUGHT
cctgcaggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaaaagcttggatccgctagcgccaccatgcagatcttcgtgaagaccctgaccggcaagaccatcaccctggaggtggagcccagtgacaccatcgagaatgtgaaggccaagatccaggataaggagggcattccccccgaccagcagaggctcatctttgcaggcaagcagctggaggatggccgcactctttctgattacaacatccagaaagagtccaccctccatctggttctgcgtctgaggggtgcggccgcagattttattttaaatatatccatgaaaatggaggtcatcttcaaaacggatttaagatcatcttcacaagttgtgtttcatgcgggtagcctgtataattggttttctgttgagattatcaatagcggtagaattgttacgaccgctataaaaacattgcttagtactgttaagtatgatattgtgaaatctgctcgtatatatgcagggcaagggtatactgaacatcaggctcaagaagaatggaatatgattctgcatgtgctgtttgaagaggagacggaatcctcagcatcttcggagaacattcatgaaaaaaatgataatgaaaccaatgaatgcacatcctcctttgaaacgttgtttgagcaagagccctcatcggaggtacctaaagactccaagctgtatatgcttgcacaaaagactgtgcaacatattgaacaatatggaaaggcacctgattttaacaaggttattagagcacataattttattcaaaccatttatggaacccctctaaaggaagaagaaaaagaggtggtaagactcatggttattaaacttttaaaaaaaataagcttttatctcacctacattaccggttccggcgagggcaggggaagtcttctaacatgcggggacgtggaggaaaatcccggcccagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaactcgaggtttaaacgaattctgcagatatccagcacagtggtcgaggggcccggagatctacgtatgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgacagctcgactctagaattgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactcggggggggggggcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattaattaattatttcagttcgagttcgttcattgcagcaatgctgaaaccgccgtcaacgtggaccacttcaccggagataccggcagagagatcggagcacaggaatgccgcagagttacccacatcttcaatagtaacggtacggcgaatcggggtaacggcttcgcaatgagccagcattttgcggaagtctttgataccggaggccgccagagtacggatcggaccagcagagatggcgttaacacgcacaccttccggacccatcgcgttcgccatatagcgcacgttcgcttccagagacgcttttgccagacccataacgttgtagttcgggatagcgcgctcagcgccaaggtaggaaagggtcagcagggcagaacccggattcagcatggagcggcaagcttttgccattgcaacgaagctgtaggagctgatgtcgtgggcaattttgaagccttcacgggtaacggcgttaacatagtcaccatccagctgatcgccaggtgcaaaaccaatagagtgtacgaaaccgtcaaatttcggccaaactttccccagttcagcgaacatggtgtcgatgctggcatcttctgcaacatcgcactgcagaacgatgtcagaacccaattgagcggcaaattcttctacgcggcctttcagtttgtcgttctggtaggtgaatgccagttcagctccttcgcggtgcatcgcctgagcgataccgtaggcgatggatagtttgctggcaacgccggttaccagaatgcgcttaccggaaagaaaacccatagctttaatccttattgttgatgcttgttgtgcctgaaaatcaggcgattcgtcgttttagtaaacagtacgaacagataaacggttattataatcaacctggctgtgagtagctatagttgccaggtccgaccggagcaggctgcggcagggggggcgcttttcccctcaccctaaccctctccccagaggggcgaggggaccgtattgtgcaaatattgttaccccagcaacaaacaggctcatacagcccctaaccctttcatggcgatggctgggacggttcagaccttgccgaatattctccagcacaatattattgaagcatttatcagggttattgtcggcgcgcctcagagattttgagacacaacgtggctttccccccccccccggcatg

SEQ ID NO: 4 - protein, 287 aa, Sus scrofa
MRICSIFTFMAYCCLLEAFTITVPKDMYEVEYGSNVTLECRFPVDKQLNLLALVVYWEMKDKKIIQFVNGEEDLNVQHSSYSQRAQLLKDQLFLGKASLQITDVKLQDAGVYCCLISYGGADYKRITLKVNAPYRKINQRMSLDPVTSEHELTCQAEGYPEAEVIWTSSDYQILSGKTTITSSQREEKLFNVTSTLRVNATTNEIFYCTFRRLGPEENSTAVLVIPEPYVDPARKRTHWVILGALLLLIAVTAIFCLKRNVRMMDVEKCGSRDMKSEKQNDTQFEET

SEQ ID NO: 5 - DNA, 513 bp, cytomegalovirus (CMV) (virus)
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 6 - DNA, 204 bp, cytomegalovirus (CMV) (virus)
gtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagct

SEQ ID NO: 7 - DNA, 304 bp, cytomegalovirus (CMV) (virus)
gcgttacataacttacggtaaatggcccgcctcgtgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccggccccctattgacgtcaatgacggtaaatggcccgcctggcattatgcccagtacatgaccttacgggactttcctacttggcagtacatctacgtattagtcatcgctattaccat

SEQ ID NO: 8 - DNA, 825 bp, cytomegalovirus (CMV) (virus)
cgtaagtaccgcctatagactctataggcacacccctttggctcttatgcatgctatactgtttttggcttggggcctatacacccccgctccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagctcggagattgggctcgcaccgtgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 9 - DNA, 956 bp, cytomegalovirus (CMV) (virus)
tcagatcgcctggagacgccatccacgctgttttgacctccatagaagacaccgggaccgatccagcctccgcggccgggaacggtgcattggaacgcggattccccgtgccaagagtgacgtaagtaccgcctatagactctataggcacacccctttggctcttatgcatgctatactgtttttggcttggggcctatacacccccgcttccttatgctataggtgatggtatagcttagcctataggtgtgggttattgaccattattgaccactcccctattggtgacgatactttccattactaatccataacatggctctttgccacaactatctctattggctatatgccaatactctgtccttcagagactgacacggactctgtatttttacaggatggggtcccatttattatttacaaattcacatatacaacaacgccgtcccccgtgcccgcagtttttattaaacatagcgtgggatctccacgcgaatctcgggtacgtgttccggacatgggctcttctccggtagcggcggagcttccacatccgagccctggtcccatgcctccagcggctcatggtcgctcggcagctccttgctcctaacagtggaggccagacttaggcacagcacaatgcccaccaccaccagtgtgccgcacaaggccgtggcggtagggtatgtgtctgaaaatgagctcggagattgggctcgcaccgctgacgcagatggaagacttaaggcagcggcagaagaagatgcaggcagctgagttgttgtattctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtcc

SEQ ID NO: 10 - DNA, 215 bp, Artificial Sequence
  SYNTHETIC CONSTRUCT DERIVED FROM HUMAN THOUGHT
gcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctgggga

SEQ ID NO: 11 - protein, 254 aa, Porcine reproductive and respiratory syndrome virus
MVNSCTFLHIFLCCSFLYSFCCAVVAGSNTTYCFWFPLVRGNFSFELTVNYTVCPPCLTRQAATEIYEPGRSLWCRIGYDRCGEDDHDELGFMIPPGLSSEGHLTSVYAWLAFLSFSYTAQFHPEIFGIGNVSRVYVDIKHQLICAEHDGQNTTLPRHDNISAVFQTYYQHQVDGGNWFHLEWLRPFFSSWLVLNVSWFLRRSPANHVSVRVLQILRPTPPQRQALLSSKTSVALGIATRPLRRFAKSLSAVRR

SEQ ID NO: 12 - protein, 254 aa, Artificial Sequence
  SYNTHETIC CONSTRUCT DERIVED FROM HUMAN THOUGHT
MVNSCTFLHIFLCCSFLYSFCCAVVAGSDTTYCFWFPLVRGDFSFELTVDYTVCPPCLTRQAATEIYEPGRSLWCRIGYDRCGEDDHDELGFMIPPGLSSEGHLTSVYAWLAFLSFSYTAQFHPEIFGIGDVSRVYVDIKHQLICAEHDGQDTTLPRHDDISAVFQTYYQHQVDGGNWFHLEWLRPFFSSWLVLDVSWFLRRSPANHVSVRVLQILRPTPPQRQALLSSKTSVALGIATRPLRRFAKSLSAVRR

SEQ ID NO: 13 - protein, 100 aa, Artificial Sequence
  SYNTHETIC CONSTRUCT DERIVED FROM HUMAN THOUGHT
MVNSCTFLHIFLCCSFLYSFCCAVVAGSDTTYCFWFPLVRGDFSFELTVDYTVCPPCLTRQAATEIYEPGRSLWCRIGYDRCGEDDHDELGFMIPPGLSS

SEQ ID NO: 14 - protein, 1273 aa, severe acute respiratory syndrom coronavirus 2 (SARS-CoV-2) (virus)
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 15 - protein, 419 aa, severe acute respiratory syndrom coronavirus 2 (SARS-CoV-2) (virus)
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 16 - protein, 222 aa, severe acute respiratory syndrom coronavirus 2 (SARS-CoV-2) (virus)
MADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQ

SEQ ID NO: 17 - protein, 132 aa, Homo sapiens
MDLPYYHGRLTKQDCETLLLKEGVDGNFLLRDSESIPGVLCLCVSFKNIVYTYRIFREKHGYYRIQTAEGSPKQVFPSLKELISKFEKPNQGMVVHLLKPIKRTSPSLRWRGLKLELETFVNSNSDYVDVLP

SEQ ID NO: 18 - DNA, 3977 bp, Mus musculus
agaatctaattatggttacctacatgagcactagtgggcggttattagagcatctgctatttgttggtggtaacaacatcaaagaccacgacactccttcccccagaaaccgttaactgccaatagtcccttggggaggggagggctccatgagcctcactcctacccatgatgaaatgttgaaggcccaagcctggcagagcttctgcagcaaaccatgaaatgtgtcatgatgggaagatgtcatttcacagcacacctccttgtctcctagctcctacattctttccaccccttcttccacagtgtttcctgagccctgatacagacgccttgcttaaagctgagtactccatcactgattctccggactttgaccagctgaggacaagagagctaagactaccagagtgctttctgttcatctttactgactgacgacctgaaaacgctatggctcgtttctcaacgtacatcatctttacctctgtcctctgtcagctaacagtcacagcagcttctggaactctgaagaaggtggccggtgcccttgatggatctgtgacattcactctgaatatcactgaaataaaggttgactatgttgtatggacgttcaacacattctttcttgccatggtaaaaaaagacggcgttacatcacaaagtagtaacaaagaaaggatagtctttccagatggactctactccatgaagctcagccaattgaagaagaatgactctggagcctaccgtgcagagatttacagtacatcgagtcaggcttccttaatccaggagtatgtgctgcatgtctacaagcatttgtcaaggcccaaggtcaccatagatcggcaaagcaacaagaatggcacctgcgtaatcaatctgacatgttccacggatcaggacggggagaatgtaacctacagctggaaagctgtggggcagggggacaatcagtttcatgatggtgccaccctctccatcgcctggagatcaggagagaaagaccaggccttaacatgcatggccaggaatccagtcagcaacagtttctcaacccccgtctttccccagaagctctgtgaagatgctgccacggatctaacttcactcaggggcatcctatacatcctgtgcttctcagcagtgctcatcctatttgctgtcttgctgactatttttcatactatgtggataaagaaaggaaaaggatgtgaggaagacaagaagagagtggacaggcaccaggaaatgcccgacttgtgccctcacttagaggagaacgcagactatgacacaatcccttacacggaaaaaagaagaccagaagaagatgcaccaaacacattttattccactgtgcagatccccaaagtggtaaagagtcccagctccctgcctgcaaagccactcgtgccaaggtcattaagctttgaaaatgttatctagatgacagcactccgtcctctccagaaaaaaacaaaacaaaacaaaactgcaaaacaaacaaaacctcaccattctgagcagaaatgaaaacttctgtcaaagactgaatgtaaatgtctccccgccagacccacatgtttgcatccagacagagaagttcaggctcaagggctttcagggtacaatgactcttggggactgggatacagcccattcagacattctgactaagaatctctctatgcccatcctgtctccggtaatgatgaatgaggctgtgctcatagacagtggactaatttgtctgatgaagaaatttttgacaaagcacagcatttggctgtggcacagccatgttcgctgtttttattcacatttatagctgtatgtaaataatctcaatcattcagttcccagataaaagacacataaccttttatatttattataagcctttatagactagagctgggcagatatctaccctctaagctatttttgcctacttccctatcaataaccccaagatataatttgccatgttccatctaggctgctcttactccaattggcccagcccttatggccatattttcatgattccccaacacaatggtgtcttctctctccaccgtctctcctcatgaacctcctgcctcagatcccaagcctgggaaccaaaacctcacctccctctcttctgccctgctataggctgccgacatctttattcacccagtagttttaaattaaggagcagggaaacatggtatcactttgtgtaggtgaggattctctagtcccagagggcaaccagaccttggggaccagtgacaagtattacaatacatagcaacagaccaaacctcagcagaactcaaaacaaagaaaaggaacaggaagatgggaaaagcatgcaggttgatagacagcatgaagggttttcaaatgggtttttcagcttcgactgtaatggttaaagggatgagcccagactgtgccctaggacaagagaaaggggacactgagagctaaaccctgtctttcaaaaaccctattcaaaaaagctttcatttaaaagaaagaatgcctgaacacagagtgtcccacatcgcacatcagactgtggaagtgtttctctgggttctcacggttctcagaggctgctggagccctgacccaagcaggtatggctccatcctggagtgacagcagaactcagcaatgtccacacgtgcagaatgtaaactctggggagccactgaagcttgcactaaggttccaggggaggaaaaccaggcaacgtgtatcgaggttgggctttctgaatggacctgccttgtaagcctgcataaaactatgaaggcaaagcctaacttgcagtttagactccaggatgctggagctgcctaaaacataaaggatgctggagctgcccagaacataaagcatctactaagaaaattttcaggcactgaaaacacccgagaaagaggccacgtgtggttttggttggaaggtcatggaaacaggcctcctcaaacccattggaacatacatgatgataccatgtacccaagatgccagatacggagcttcaaggcttatacctctctgctgagttttctcctatctttggctctttctttgccacgccccatccctcccttttggaatgtgaatgtttcctctgccattgtgcattgaaagtatgtgagttttctattttttaagagctcacaactaggactttgccttacatctcataaaagacattggacattgaactgttatggctagggactcttgaagttagatggaatgtgttttgcattgtgtgatgaccgtaggcatattgagccaagacctgtgagccaagacgggagtgttatggattgagtcgaaaagattcaaggttgcgggcttgtgtggttcaacacttggtgttatttaagggtgctgtagaccctatagaagatagagtctgtctgcagacggtgagtctccaggaggcaggcctagaaagtgacagtcactcctggctctgggcaagccttctgctccacctcaggcagaatcctgtccaccatgttatgaagaagcagacattgcaaactccctccaacacaggccaagcccctaaagccgccatgcctctgatgacaatggattataacctctagaactcaaaatcgaaagcaggcccttcccctgtaagttgctcctgccaggattttggcagtgtggtagctgataccacttccttccagaataagctattctcagcctctttggactctgaggttcatcgtccaattgctgagaactctcctcaaacccagaatctgtattcctttctgccagtgtgactgaatctgtcagttagcccagagaaaatgactgggagatgcctgaaattgctccaaataagtctattaatttattaatggaaccagcagctatgagccaggtgctgtgttacactttcatggattgttgcaatacactcactcttgcttgat

SEQ ID NO: 19 - protein, 132 aa, Mus musculus
MDLPYYHGCLTKRECEALLLKGGVDGNFLIRDSESVPGALCLCVSFKKLVYSYRIFREKHGYYRIETNAHTPRTIFPNLQELVSKYGKPGQGLVVHLSNPIMRNNLCQRGRRMELELNVYENTDKEYVDVLP

SEQ ID NO: 20 - protein, 1272 aa, Artificial Sequence
  SYNTHETIC CONSTRUCT DERIVED FROM HUMAN THOUGHT
  MISC_FEATURE (17)..(17): X17 IS N OR D
  MISC_FEATURE (61)..(61): X61 IS N OR D
  MISC_FEATURE (73)..(73): X73 IS N OR D
  MISC_FEATURE (121)..(121): X121 IS N OR D
  MISC_FEATURE (148)..(148): X148 IS N OR D
  MISC_FEATURE (164)..(164): X164 IS N OR D
  MISC_FEATURE (233)..(233): X233 IS N OR D
  MISC_FEATURE (281)..(281): X281 IS N OR D
  MISC_FEATURE (330)..(330): X330 IS N OR D
  MISC_FEATURE (342)..(342): X342 IS N OR D
  MISC_FEATURE (602)..(602): X602 IS N OR D
  MISC_FEATURE (615)..(615): X615 IS N OR D
  MISC_FEATURE (656)..(656): X656 IS N OR D
  MISC_FEATURE (708)..(708): X708 IS N OR D
  MISC_FEATURE (716)..(716): X716 IS N OR D
  MISC_FEATURE (800)..(800): X800 IS N OR D
  MISC_FEATURE (1073)..(1073): X1073 IS N OR D
  MISC_FEATURE (1097)..(1097): X1097 IS N OR D
  MISC_FEATURE (1133)..(1133): X1133 IS N OR D
  MISC_FEATURE (1134)..(1134): X1134 IS N OR D
  MISC_FEATURE (1157)..(1157): X1157 IS N OR D
  MISC_FEATURE (1172)..(1172): X1172 IS N OR D
  MISC_FEATURE (1193)..(1193): X1193 IS N OR D
MFVFLVLLPLVSSQCVXLTTRTQLPPAYTNSFTRGVYYPDKVFRSSVLHSTQDLFLPFFSXVTWFHAIHSGTXGTKRFDNPVLPFNDGVYFASTEKSNIIRGWIFGTTLDSKTQSLLIVNXATNVVIKVCEFQFCNDPFLGVYYHKNXKSWMESEFRVYSSANXCTFEYVSQPFLMDLEGKQGNFKNLREFVFKNIDGYFKIYSKHTPINLVRDLPQGFSALEPLVDLPIGIXITRFQTLLALHRSYLTPGDSSSGWTAGAAAYYVGYLQPRTFLLKYNEXGTITDAVDCALDPLSETKCTLKSFTVEKGIYQTSNFRVQPTESIVRFPXITNLCPFGEVFXATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTXTSNQVAVLYQDVXCTEVPVAIHADQLTPTWRVYSTGSNVFQTRAGCLIGAEHVXNSYECDIPIGAGICASYQTQTNSPRRARSVASQSIIAYTMSLGAENSVAYSXNSIAIPTXFTISVTTEILPVSMTKTSVDCTMYICGDSTECSNLLLQYGSFCTQLNRALTGIAVEQDKNTQEVFAQVKQIYKTPPIKDFGGFXFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKXFTTAPAICHDGKAHFPREGVFVSXGTHWFVTQRNFYEPQIITTDNTFVSGNCDVVIGIVXXTVYDPLQPELDSFKEELDKYFKXHTSPDVDLGDISGIXASVVNIQKEIDRLNEVAKNLXESLIDLQELGKYEQYIKWPWYIWLGFIAGLIAIVMVTIMLCCMTSCCSCLKGCCSCGSCCKFDEDDSEPVLKGVKLHYT

SEQ ID NO: 21 - protein, 419 aa, Artificial Sequence
  SYNTHETIC CONSTRUCT DERIVED FROM HUMAN THOUGHT
  MISC_FEATURE (47)..(47): X47 IS N OR D
  MISC_FEATURE (48)..(48): X48 IS N OR D
  MISC_FEATURE (77)..(77): X77 IS N OR D
  MISC_FEATURE (192)..(192): X192 IS N OR D
  MISC_FEATURE (196)..(196): X196 IS N OR D
  MISC_FEATURE (269)..(269): X269 IS N OR D
MSDNGPQNQRNAPRITFGGPSDSTGSNQNGERSGARSKQRRPQGLPXXTASWFTALTQHGKEDLKFPRGQGVPINTXSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRXSSRXSTPGSSRGTSPARMAGNGGDAALALLLLDRLNQLESKMSGKGQQQQGQTVTKKSAAEASKKPRQKRTATKAYXVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 22 - protein, 222 aa, Artificial Sequence
  SYNTHETIC CONSTRUCT DERIVED FROM HUMAN THOUGHT
MADSDGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQ

SEQ ID NO: 23 - protein, 203 aa, African swine fever virus
AAADFILNISMKMEVIFKTDLRSSSQVVFHAGSLYNWFSVEIINSGRIVTTAIKTLLSTVKYDIVKSARIYAGQGYTEHQAQEEWNMILHVLFEEETESSASSENIHEKNDNETNECTSSFETLFEQEPSSEVPKDSKLYMLAQKTVQHIEQYGKAPDFNKVIRAHNFIQTIYGTPLKEEEKEVVRLMVIKLLKKISFYLTYI

SEQ ID NO: 24 - protein, 233 aa, porcine circovirus 2 (virus)
MTYPRRRYRRRRHRPRSHLGQILRRRPWLVHPRHRYRWRRKNGIFNTRLSRTFGYTVKATTVRTPSWAVDMMRFNIDDFVPPGGGTNKISIPFEYYRIRKVKVEFWPCSPITQGDRGVGSTAVILDDNFVTKATALTYDPYVNYSSRHTIPQPFSYHSRYFTPKPVLDSTIDYFQPNNKRTQLWLRLQTSRNVDHVGLGTAFENSIYDQDYNIRVTMYVQFREFNLKDPPLKP

SEQ ID NO: 25 - protein, 233 aa, Artificial Sequence
  SYNTHETIC CONSTRUCT DERIVED FROM HUMAN THOUGHT
MTYPRRRYRRRRHRPRSHLGQILRRRPWLVHPRHRYRWRRKNGIFNTRLSRTFGYTVKATTVRTPSWAVDMMRFNIDDFVPPGGGTNKISIPFEYYRIRKVKVEFWPCSPITQGDRGVGSTAVILDDNFVTKATALTYDPYVDYSSRHTIPQPFSYHSRYFTPKPVLDSTIDYFQPNNKRTQLWLRLQTSRNVDHVGLGTAFENSIYDQDYNIRVTMYVQFREFNLKDPPLKP

SEQ ID NO: 26 - protein, 203 aa, Artificial Sequence
  SYNTHETIC CONSTRUCT DERIVED FROM HUMAN THOUGHT
AAADFILDISMKMEVIFKTDLRSSSQVVFHAGSLYNWFSVEIINSGRIVTTAIKTLLSTVKYDIVKSARIYAGQGYTEHQAQEEWNMILHVLFEEETESSASSENIHEKNDNETNECTSSFETLFEQEPSSEVPKDSKLYMLAQKTVQHIEQYGKAPDFNKVIRAHNFIQTIYGTPLKEEEKEVVRLMVIKLLKKISFYLTYI

SEQ ID NO: 27 - protein, 203 aa, Artificial Sequence
  SYNTHETIC CONSTRUCT DERIVED FROM HUMAN THOUGHT
AAADFILNISMKMEVIFKTDLRSSSQVVFHAGSLYNWFSVEIINSGRIVTTAIKTLLSTVKYDIVKSARIYAGQGYTEHQAQEEWNMILHVLFEEETESSASSENIHEKNDDETNECTSSFETLFEQEPSSEVPKDSKLYMLAQKTVQHIEQYGKAPDFNKVIRAHNFIQTIYGTPLKEEEKEVVRLMVIKLLKKISFYLTYI

SEQ ID NO: 28 - protein, 203 aa, Artificial Sequence
  SYNTHETIC CONSTRUCT DERIVED FROM HUMAN THOUGHT
AAADFILDISMKMEVIFKTDLRSSSQVVFHAGSLYNWFSVEIINSGRIVTTAIKTLLSTVKYDIVKSARIYAGQGYTEHQAQEEWNMILHVLFEEETESSASSENIHEKNDDETNECTSSFETLFEQEPSSEVPKDSKLYMLAQKTVQHIEQYGKAPDFNKVIRAHNFIQTIYGTPLKEEEKEVVRLMVIKLLKKISFYLTYI

SEQ ID NO: 29 - protein, 394 aa, human herpes simplex virus-1 (virus)
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 30 - protein, 292 aa, human herpes simplex virus-1 (virus)
RGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQI

SEQ ID NO: 31 - protein, 79 aa, human herpes simplex virus-1 (virus)
PPNWHIPSIQDAATPYHPPATPNNMGLIAGAVGGSLLAALVICGIVYWMHRRTRKAPKRIRLPHIREDDQPSSHQPLFY

SEQ ID NO: 32 - protein, 10 aa, human herpes simplex virus-1 (virus)
PPNWHIPSIQ

SEQ ID NO: 33 - protein, 19 aa, human herpes simplex virus-1 (virus)
PPNWHIPSIQDAATPYHPP

SEQ ID NO: 34 - protein, 25 aa, human herpes simplex virus-1 (virus)
PPNWHIPSIQDAATPYHPPATPNNM

SEQ ID NO: 35 - protein, 244 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGP

SEQ ID NO: 36 - protein, 125 aa, human herpes simplex virus-1 (virus)
KAPYTSTLLPPELSETPNATQPELAPEDPEDSALLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 37 - protein, 71 aa, human herpes simplex virus-1 (virus)
KAPYTSTLLPPELSETPNATQPELAPEDPEDSALLEDPVGTVAPQIPPNWHIPSIQDAATPYHPPATPNNM

SEQ ID NO: 38 - protein, 39 aa, human herpes simplex virus-1 (virus)
KAPYTSTLLPPELSETPNATQPELAPEDPEDSALLEDPV

SEQ ID NO: 39 - protein, 33 aa, human herpes simplex virus-1 (virus)
KAPYTSTLLPPELSETPNATQPELAPEDPEDSA

SEQ ID NO: 40 - protein, 230 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRT

SEQ ID NO: 41 - protein, 139 aa, human herpes simplex virus-1 (virus)
VAVYSLKIAGWHGPKAPYTSTLLPPELSETPNATQPELAPEDPEDSALLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 42 - protein, 85 aa, human herpes simplex virus-1 (virus)
VAVYSLKIAGWHGPKAPYTSTLLPPELSETPNATQPELAPEDPEDSALLEDPVGTVAPQIPPNWHIPSIQDAATPYHPPATPNNM

SEQ ID NO: 43 - protein, 53 aa, human herpes simplex virus-1 (virus)
VAVYSLKIAGWHGPKAPYTSTLLPPELSETPNATQPELAPEDPEDSALLEDPV

SEQ ID NO: 44 - protein, 47 aa, human herpes simplex virus-1 (virus)
VAVYSLKIAGWHGPKAPYTSTLLPPELSETPNATQPELAPEDPEDSA

SEQ ID NO: 45 - protein, 288 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAP

SEQ ID NO: 46 - protein, 81 aa, human herpes simplex virus-1 (virus)
QIPPNWHIPSIQDAATPYHPPATPNNMGLIAGAVGGSLLAALVICGIVYWMHRRTRKAPKRIRLPHIREDDQPSSHQPLFY

SEQ ID NO: 47 - protein, 27 aa, human herpes simplex virus-1 (virus)
QIPPNWHIPSIQDAATPYHPPATPNNM

SEQ ID NO: 48 - protein, 21 aa, human herpes simplex virus-1 (virus)
QIPPNWHIPSIQDAATPYHPP

SEQ ID NO: 49 - protein, 17 aa, human herpes simplex virus-1 (virus)
QIPPNWHIPSIQDAATP

SEQ ID NO: 50 - protein, 208 aa, human herpes simplex virus-1 (virus)
PVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRT

SEQ ID NO: 51 - protein, 222 aa, human herpes simplex virus-1 (virus)
PVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGP

SEQ ID NO: 52 - protein, 266 aa, human herpes simplex virus-1 (virus)
PVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAP

SEQ ID NO: 53 - protein, 201 aa, human herpes simplex virus-1 (virus)
DPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRT

SEQ ID NO: 54 - protein, 215 aa, human herpes simplex virus-1 (virus)
DPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGP

SEQ ID NO: 55 - protein, 259 aa, human herpes simplex virus-1 (virus)
DPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAP

SEQ ID NO: 56 - protein, 198 aa, human herpes simplex virus-1 (virus)
GVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRT

SEQ ID NO: 57 - protein, 212 aa, human herpes simplex virus-1 (virus)
GVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGP

SEQ ID NO: 58 - protein, 256 aa, human herpes simplex virus-1 (virus)
GVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAP

SEQ ID NO: 59 - protein, 267 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPE

SEQ ID NO: 60 - protein, 92 aa, human herpes simplex virus-1 (virus)
LLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 61 - protein, 50 aa, human herpes simplex virus-1 (virus)
PELAPEDPEDSALLEDPVGTVAPQIPPNWHIPSIQDAATPYHPPATPNNM

SEQ ID NO: 62 - protein, 18 aa, human herpes simplex virus-1 (virus)
PELAPEDPEDSALLEDPV

SEQ ID NO: 63 - protein, 12 aa, human herpes simplex virus-1 (virus)
PELAPEDPEDSA

SEQ ID NO: 64 - protein, 255 aa, human herpes simplex virus-1 (virus)
PVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSA

SEQ ID NO: 65 - protein, 293 aa, human herpes simplex virus-1 (virus)
PVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNM

SEQ ID NO: 66 - protein, 347 aa, human herpes simplex virus-1 (virus)
PVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 67 - protein, 248 aa, human herpes simplex virus-1 (virus)
DPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSA

SEQ ID NO: 68 - protein, 254 aa, human herpes simplex virus-1 (virus)
DPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPV

SEQ ID NO: 69 - protein, 286 aa, human herpes simplex virus-1 (virus)
DPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNM

SEQ ID NO: 70 - protein, 340 aa, human herpes simplex virus-1 (virus)
DPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 71 - protein, 245 aa, human herpes simplex virus-1 (virus)
GVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSA

SEQ ID NO: 72 - protein, 233 aa, human herpes simplex virus-1 (virus)
GVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQ

SEQ ID NO: 73 - protein, 283 aa, human herpes simplex virus-1 (virus)
GVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNM

SEQ ID NO: 74 - protein, 337 aa, human herpes simplex virus-1 (virus)
GVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 75 - protein, 54 aa, human herpes simplex virus-1 (virus)
GLIAGAVGGSLLAALVICGIVYWMHRRTRKAPKRIRLPHIREDDQPSSHQPLFY

SEQ ID NO: 76 - protein, 32 aa, human herpes simplex virus-1 (virus)
KYALADASLKMADPNRFRGKDLPVLDRLTDPP

SEQ ID NO: 77 - protein, 29 aa, human herpes simplex virus-1 (virus)
KYALADASLKMADPNRFRGKDLPVLDRLT

SEQ ID NO: 78 - protein, 22 aa, human herpes simplex virus-1 (virus)
KYALADASLKMADPNRFRGKDL

SEQ ID NO: 79 - protein, 25 aa, human herpes simplex virus-1 (virus)
MGGAAARLGAVILFVVIVGLHGVRG

SEQ ID NO: 80 - protein, 23 aa, human herpes simplex virus-1 (virus)
MGGAAARLGAVILFVVIVGLHGV

SEQ ID NO: 81 - protein, 21 aa, human herpes simplex virus-1 (virus)
GLIAGAVGGSLLAALVICGIV

SEQ ID NO: 82 - protein, 315 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNM

SEQ ID NO: 83 - protein, 369 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 84 - protein, 394 aa, Artificial Sequence
  SYNTHETIC CONSTRUCT DERIVED FROM HUMAN THOUGHT
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNAHIPSIQDAATPYHPPATPNNMGLIAGAVGGSLLAALVICGIVYWMHRRTRKAPKRIRLPHIREDDQPSSHQPLFY

SEQ ID NO: 85 - DNA, 2531 bp, Homo sapiens
agaggaagaggtagctccacaggaggtacagctgcttacacatctctcctcagagctgtcccttgacttgggggtgaatttcaggccaacagggcttcctgggatacaagagcgttctccatggatctgccttactaccatggacgtctgaccaagcaagactgtgagaccttgctgctcaaggaaggggtggatggcaactttcttttaagagacagcgagtcgataccaggagtcctgtgcctctgtgtctcgtttaaaaatattgtctacacataccgaatcttcagagagaaacacgggtattacaggatacagactgcagaaggttctccaaaacaggtctttccaagcctaaaggaactgatctccaaatttgaaaaaccaaatcaggggatggtggttcaccttttaaagccaataaagagaaccagccccagcttgagatggagaggattgaaattagagttggaaacatttgtgaacagtaacagcgattatgtggatgtcttgccttgaagataaggctgccggacaaagcaagttgaagagatgagtaacagttctcactgatgacccacttctgcaggcataggtccagagcaccaaactctagtggacaattcagactctcctggttgtgtaactgaagatgttctgcccaccagcaccagaggtcactctccacatccccgcctcccagacatataccaggagcaatttcaaaaccctctccagtttcactcttctttcttggaatgggacagcctgaacattttccctttgacttgttaaaggtaccaccctacatcatggttgacaccctcctttggaccatgcagtcagaggggcagctttatacagaggaggggcacacttgtctgtgagtttgaagccctgagttccagtcctgtggctgtgtgactttgaacacgtttctgcccatctccaggtcttagtttctttgtctctgtggttgggtgggatgataaacattgccccagtctctctgttgagcctgcttgtgtcaggtgaaggtgagggatcgggagtgatggagatgcatacagatcagcaccttctctgtacctgctggacccccatgtgcacccttctccctccagcctgggctactctcctcctggttctttctaatcttaaacttcctggtgagcattgccccagccacactttctccctggttttgcttaattccacttatgcatcagtcatttcaacagcatgaatgtggttctgtacagtgatgtatgtggagatttctaaaatattctatgtgtgatttctgttcccaactaggttctaagtgccatcaaagcacggttgggtctcccttgtatcttccacagtgtgtagaaatttgtgctgcccagagctgtgcctagttcatagaaactgactggaagcacattgctgagggaggtttgttgaattggtttttaaggtttactgaaattgatttgctgaatttttctgctagttcaaaatgtgaattaggacctggtcagtttgaaatataccaaattctatgccctttctcttacctatcatcaaattgtagtaatgtatttcaccccactggacttatcttcagagttttaaaagagaggagctctcgacttagaggtaatatgaacagatgaacagacactgtggctggagccccaaagtgtggagcattgtgagatttggggtcacagcaatttatggctactattccctgggtctggtaggtaggacaaatgtcctcttttacttttcaaaactggcttaggtattcatggaccttgattcttctatatacattttataataaatacgtgaaattgcttaaaacctctttttggaatttttaatgaacttgcaacaaatttgtaaataggagagaactgacgttcttgtgatgttttcccatgcataaacatgccacatccatgttcttgggtcatcttttttgccctttcatggagtcataaattttcccaactgaagtcttgtatattctgttagattaattcctatttctagttgctgtaaatgatatcttatgttttattacatttctaataggatatggtgttggtgaaatgttaaccctctcattagatctactagtttacctgttgattctattgtgttttctatgtaaatgattttgtcagctataaataataacattttattttctctttccttgcaatacctatgctcatttattttttatgtttacccattggttagggcctcctgtatacattaaacagttcatagtcatgatagtgagtattcttacactgttcccagtattacagggaatgcttagaaattttctttatttaaacattatgtttgttgtagccttgttaaaggctattttataatttttactagaaatattttgacatttattgtgatttttttctatctctaatctattgagatagtcacattccttttgtcttcactccattataaaggtaagttaccttaataaaattgttgatatcatttca

SEQ ID NO: 86 - DNA, 1172 bp, Mus musculus
tactccaagaacgatctttccaaacctacaggaattggtctccaaatatggaaaaccgggtcaaggattggtggttcacctttcaaacccaataatgagaaacaacctatgccaaagagggagaagaatggagttagagctgaatgtttatgagaacactgataaggagtatgtggacgtcttgccttgaagacaaggacattggacaaagcaagctagaggagagatggctctgctctcagctgccacatctgcaagtgtgaatctaaaatgccaatttctagtgagccactgagatcctctgattgggatagcaagatctgttctgcaaccttggaggagtcatttctcagacgcctgcctcctggcatattcctcaagaggctccaaagccactccttacttcttactcccctatcttgaaattggacagccagaacccaatctcctgtctggatagaggcagctcccctcattccttcatggttgacaacttccgacaggacaatgggaagtgaagtggaaagagtacttcatacagcagaaagaatactcaatagtgacttcagagttcccatcctgtgactctgtggctttggagaaatcaccccctcgttctcagcttcttcatctattaaacaattggttgatacacattacctggactctctattgagccaggtggagcaggggtttgagcagcaggatcaggatctaaggatactgaaggagcaaacatgtccttcctacctgtgaggtcgtggtcctgatgggggctgtgacccaacctgaaactgtaggttttttcacctgagctccagttcctgaataataaatactccttgacttgttacttatgaattaatgcctaaactttgagctagaattcttacatagattgtaacttactgaacccatttataccattctgttctgttgcatgcctgcttacctctcctcagtgtcatacctttgacttcctcccagacttggtcgtagcaaatctttccttgcctaattatttcccagagttactctcttctttctctgacagatttccttccttcaaatcctgccttaacttcttggccatcaggtatttattgacaggtgatacttccacagaatacacgagagattattcctactctacccattctcccgttcccttc

SEQ ID NO: 87 - protein, 45 aa, human herpes simplex virus-1 (virus)
VAVYSLKIAGWHGPKAPYTSTLLPPELSETPNATQPELAPEDPED

SEQ ID NO: 88 - protein, 55 aa, human herpes simplex virus-1 (virus)
VAVYSLKIAGWHGPKAPYTSTLLPPELSETPNATQPELAPEDPEDSALLEDPVGT

SEQ ID NO: 89 - protein, 35 aa, human herpes simplex virus-1 (virus)
VAVYSLKIAGWHGPKAPYTSTLLPPELSETPNATQ

SEQ ID NO: 90 - protein, 20 aa, human herpes simplex virus-1 (virus)
VAVYSLKIAGWHGPKAPYTS

SEQ ID NO: 91 - protein, 229 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQR

SEQ ID NO: 92 - protein, 275 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPED

SEQ ID NO: 93 - protein, 285 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGT

SEQ ID NO: 94 - protein, 265 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQ

SEQ ID NO: 95 - protein, 250 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTS

SEQ ID NO: 96 - protein, 300 aa, human herpes simplex virus-1 (virus)
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPED

SEQ ID NO: 97 - protein, 310 aa, human herpes simplex virus-1 (virus)
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGT

SEQ ID NO: 98 - protein, 290 aa, human herpes simplex virus-1 (virus)
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQ

SEQ ID NO: 99 - protein, 275 aa, human herpes simplex virus-1 (virus)
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTS

SEQ ID NO: 100 - protein, 255 aa, human herpes simplex virus-1 (virus)
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRT

SEQ ID NO: 101 - protein, 32 aa, human herpes simplex virus-1 (virus)
GTVAPQIPPNWHIPSIQDAATPYHPPATPNNM

SEQ ID NO: 102 - protein, 243 aa, human herpes simplex virus-1 (virus)
PVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQ

SEQ ID NO: 103 - protein, 340 aa, human herpes simplex virus-1 (virus)
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGPKAPYTSTLLPPELSETPNATQPELAPEDPEDSALLEDPVGTVAPQIPPNWHIPSIQDAATPYHPPATPNNM

SEQ ID NO: 104 - protein, 38 aa, human herpes simplex virus-1 (virus)
LLEDPVGTVAPQIPPNWHIPSIQDAATPYHPPATPNNM

SEQ ID NO: 105 - protein, 86 aa, human herpes simplex virus-1 (virus)
GTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 106 - protein, 71 aa, human herpes simplex virus-1 (virus); identical to SEQ ID NO: 37

SEQ ID NO: 107 - protein, 104 aa, human herpes simplex virus-1 (virus)
PELAPEDPEDSALLEDPVGTVAPQIPPNWHIPSIQDAATPYHPPATPNNMGLIAGAVGGSLLAALVICGIVYWMHRRTRKAPKRIRLPHIREDDQPSSHQPLFY

SEQ ID NO: 108 - protein, 269 aa, human herpes simplex virus-1 (virus)
MGGAAARLGAVILFVVIVGLHGVRGKYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYSLKIAGWHGP

SEQ ID NO: 109 - protein, 70 aa, human herpes simplex virus-1 (virus)
DSALLEDPVGTVAPQIPPNWHIPSIQDAATPYHPPATPNNMGLIAGAVGGSLLAALVICGIVYWMHRRTR

SEQ ID NO: 110 - protein, 244 aa, human herpes simplex virus-1 (virus); identical to SEQ ID NO: 35

SEQ ID NO: 111 - protein, 222 aa, human herpes simplex virus-1 (virus); identical to SEQ ID NO: 51

SEQ ID NO: 112 - protein, 215 aa, human herpes simplex virus-1 (virus); identical to SEQ ID NO: 54

SEQ ID NO: 113 - protein, 212 aa, human herpes simplex virus-1 (virus); identical to SEQ ID NO: 57

SEQ ID NO: 114 - protein, 41 aa, human herpes simplex virus-1 (virus)
DSALLEDPVGTVAPQIPPNWHIPSIQDAATPYHPPATPNNM

SEQ ID NO: 115 - protein, 235 aa, human herpes simplex virus-1 (virus)
KYALADASLKMADPNRFRGKDLPVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYS

SEQ ID NO: 116 - protein, 213 aa, human herpes simplex virus-1 (virus)
PVLDRLTDPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYS

SEQ ID NO: 117 - protein, 206 aa, human herpes simplex virus-1 (virus)
DPPGVRRVYHIQAGLPDPFQPPSLPITVYYAVLERACRSVLLNAPSEAPQIVRGASEDVRKQPYNLTIAWFRMGGNCAIPITVMEYTECSYNKSLGACPIRTQPRWNYYDSFSAVSEDNLGFLMHAPAFETAGTYLRLVKINDWTEITQFILEHRAKGSCKYALPLRIPPSACLSPQAYQQGVTVDSIGMLPRFIPENQRTVAVYS

SEQ ID NO: 118 - protein, 36 aa, human herpes simplex virus-1 (virus)
ILEHRAKGSCKYALPLRIPPSACLSPQAYQQGVTVD

SEQ ID NO: 119 - protein, 11 aa, human herpes simplex virus-1 (virus)
QPELAPEDPED

SEQ ID NO: 120 - protein, 180 aa, Porcine reproductive and respiratory syndrome virus
MSGILDRCTCTPNARVFMAEGQVYCTRCLSARSLLPLNLQVSELGVLGLFYRPEEPLRWTLPRAFPTVECSPAGACWLSAIFPIARMTSGNLNFQQRMVRVAAELYRAGQLTPAVLKALQVYERGCRWYPIVGPVPGVAVFANSLHVSDKPFPGATHVLTNLPLPQRPKPEDFCPFECAM

SEQ ID NO: 121 - protein, 203 aa, Porcine reproductive and respiratory syndrome virus
ATVYDIGHDAVMYVAERKVSWAPRGGDEVKFEAVPGELKLIANRLRTSFPPHHTVDMSKFAFTAPGCGVSMRVERQHGCLPADTVPEGNCWWSLFDLLPLEVQNKEIRHANQFGYQTKHGVSGKYLQRRLQVNGLRAVTDLNGPIVVQYFSVKESWIRHLKLAGEPSYSGFEDLLRIRVEPNTSPLADKEEKIFRFGSHKWYG

SEQ ID NO: 122 - protein, 1196 aa, Porcine reproductive and respiratory syndrome virus
AGKRARKARSCATATVAGRALSVRETRQAKEHEVAGANKAEHLKHYSPPAEGNCGWHCISAIANRMVNSKFETTLPERVRPPDDWATDEDLVNAIQILRLPAALDRNGACTSAKYVLKLEGEHWTVTVTPGMSPSLLPLECVQGCCGHKGGLGSPDAVEVSGFDPACLDRLAEVMHLPSSAIPAALAEMSGDSDRSASPVTTVWTVSQFFARHSGGNHPDQVRLGKIISLCQVIEDCCCSQNKTNRVTPEEVAAKIDLYLRGATNLEECLARLEKARPPRVIDTSFDWDVVLPGVEAATQTIKLPQVNQCRALVPVVTQKSLDNNSVPLTAFSLANYYYRAQGDEVRHRERLTAVLSKLEKVVREEYGLMPTEPGPRPTLPRGLDELKDQMEEDLLKLANAQTTSDMMAWAVEQVDLKTWVKNYPRWTPPPPPPKVQPRKTKPVKSLPERKPVPAPRRKVGSDCGSPVSLGGDVPNSWEDLAVSSPFDLPTPPEPATPSSELVIVSSPQCIFRPATPLSEPAPIPAPRGTVSRPVTPLSEPIPVPAPRRKFQQVKRLSSAAAIPPYQDEPLDLSASSQTEYEASPPAPPQSGGVLGVEGHEAEETLSEISDMSGNIKPASVSSSSSLSSVRITRPKYSAQAIIDSGGPCSGHLQEVKETCLSVMREACDATKLDDPATQEWLSRMWDRVDMLTWRNTSVYQAICTLDGRLKFLPKMILETPPPYPCEFVMMPHTPAPSVGAESDLTIGSVATEDVPRILEKIENVGEMANQGPLAFSEDKPVDDQLVNDPRISSRRPDESTSAPSAGTGGAGSFTDLPPSDGADADGGGPFRTVKRKAERLFDQLSRQVFDLVSHLPVFFSRLFYPGGGYSPGDWGFAAFTLLCLFLCYSYPAFGIAPLLGVFSGSSRRVRMGVFGCWLAFAVGLFKPVSDPVGAACEFDSPECRNILHSFELLKPWDPVRSLVVGPVGLGLAILGRLLGGARCIWHFLLRLGIVADCILAGAYVLSQGRCKKCWGSCIRTAPNEVAFNVFPFTRATRSSLIDLCDRFCAPKGMDPIFLATGWRGCWAGRSPIEQPSEKPIAFAQLDEKKITARTVVAQPYDPNQAVKCLRVLQSGGAMVAKAVPKVVKVSAVPFRAPFFPTGVKVDPDCRVVVDPDTFTAALRSGYSTTNLVLGVGDFAQLNGLKIRQISKPSGG

SEQ ID NO: 123 - protein, 230 aa, Porcine reproductive and respiratory syndrome virus
GPHLMAALHVACSMALHMLAGIYVTAVGSCGTGTNDPWCANPFAVPGYGPGSLCTSRLCISQHGLTLPLTALVAGFGIQEIALVVLIFVSIGGMAHRLSCKADMLCVLLAIASYVWVPLTWLLCVFPCWLRCFSLHPLTILWLVFFLISVNMPSGILAMVLLVSLWLLGRYTNVAGLVTPYDIHHYTSGPRGVAALATAPDGTYLAAVRRAALTGRTMLFTPSQLGSLLE

SEQ ID NO: 124 - protein, 204 aa, Porcine reproductive and respiratory syndrome virus
GAFRTRKPSLNTVNVIGSSMGSGGVFTIDGKVKCVTAAHVLTGNSARVSGVGFNQMLDFDVKGDFAIADCPNWQGAAPKTQFCTDGWTGRAYWLTSSGVEPGVIGKGFAFCFTACGDSGSPVITEAGELVGVHTGSNKQGGGIVTRPSGQFCNVAPIKLSELSEFFAGPKVPLGDVKVGSHIIKDISEVPSDLCALLAAKPELE

SEQ ID NO: 125 - protein, 170 aa, Porcine reproductive and respiratory syndrome virus
GGLSTVQLLCVFFLLWRMMGHAWTPLVAVSFFILNEVLPAVLVRSVFSFGMFVLSWLTPWSAQVLMIRLLTAALNRNRWSLAFFSLGAVTGFVADLAATQGHPLQAVMNLSTYAFLPRMMVVTSPVPVITCGVVHLLAIILYLFKYRGPHHILVGDGVFSAAFFLRYFAE

SEQ ID NO: 126 - protein, 165 aa, Porcine reproductive and respiratory syndrome virus
GKLREGVSQSCGMNHESLTGALAMRLNDEDLDFLMKWTDFKCFVSASNMRNAAGQFIEAAYAKALRVELAQLVQVDKVRGTLAKLEAFADTVAPQLSPGDIVVALGHTPVGSIFDLKVGSTKHTLQAIETRVLAGSKMTVARVVDPTPTPPPAPVPIPLPPKVLE

SEQ ID NO: 127 - protein, 111 aa, Porcine reproductive and respiratory syndrome virus
NGPNAWGDEDRLNKKKRRRMEALGIYVMGGKKYQKFWDKNSGDVFYEEVHNNTDEWECLRVGDPADFDPEKGTLCGHVTIENKAYHVYTSPSGKKFLVPVNPENGRVQWEA

SEQ ID NO: 128 - protein, 44 aa, Porcine reproductive and respiratory syndrome virus
AKLSVEQALGMMNVDGELTAKELEKLKRIIDKLQGLTKEQCLNC

SEQ ID NO: 129 - protein, 684 aa, Porcine reproductive and respiratory syndrome virus
AKLSVEQALGMMNVDGELTAKELEKLKRIIDKLQGLTKEQCLNCLAASDLTRCGRGGLVVTETAVKIVKFHNRTFTLGPVNLKVASEVELKDAVEHNQHPVARPIDGGVVLLRSAVPSLIDVLISGADASPKLLAHHGPGNTGIDGTLWDFESEATKEEVALSAQIIQACDIRRGDAPEIGLPYKLYPVRGNPERVKGVLQNTRFGDIPYKTPSDTGSPVHAAACLTPNATPVTDGRSVLATTMPPGFELYVPTIPASVLDYLDSRPDCPKQLTEHGCEDAALKDLSKYDLSTQGFVLPGVLRLVRKYLFAHVGKCPPVHRPSTYPAKNSMAGINGNRFPTKDIQSVPEIDVLCAQAVRENWQTVTPCTLKKQYCGKKKTRTILGTNNFIALAHRAVLSGVTQGFMKKAFNSPIALGKNKFKELQTPVLGRCLEADLASCDRSTPAIVRWFAANLLYELACAEEHLPSYVLNCCHDLLVTQSGAVTKRGGLSSGDPITSVSNTIYSLVIYAQHMVLSYFKSGHPHGLLFLQDQLKFEDMLKVQPLIVYSDDLVLYAESPTMPNYHWWVEHLNLMLGFQTDPKKTAITDSPSFLGCRIINGRQLVPNRDRILAALAYHMKASNVSEYYASAAAILMDSCACLEYDPEWFEELVVGIAQCARKDGYSFPGTPFFMSMWEKLRSNYE

SEQ ID NO: 130 - protein, 441 aa, Porcine reproductive and respiratory syndrome virus
GKKSRVCGYCGAPAPYATACGLDVCIYHTHFHQHCPVTIWCGHPAGSGSCSECKSPVGKGTSPLDEVLEQVPYKPPRTVIMHVEQGLTPLDPGRYQTRRGLVSVRRGIRGNEVGLPDGDYASTALLPTCKEINMVAVASNVLRSRFIIGPPGAGKTYWLLQQVQDGDVIYTPTHQTMLDMIRALGTCRFNVPAGTTLQFPVPSRTGPWVRILAGGWCPGKNSFLDEAAYCNHLDVLRLLSKTTLTCLGDFKQLHPVGFDSHCYVFDIMPQTQLKTIWRFGQNICDAIQPDYRDKLMSMVNTTRVTYVEKPVRYGQVLTPYHRDREDDAITIDSSQGATFDVVTLHLPTKDSLNRQRALVAITRARHAIFVYDPHRQLQGLFDLPAKGTPVNLAVHCDGQLIVLDRNNKECTVAQALGNGDKFRATDKRVVDSLRAICADLE

SEQ ID NO: 131 - protein, 223 aa, Porcine reproductive and respiratory syndrome virus
GSSSPLPKVAHNLGFYFSPDLTQFAKLPVELAPHWPVVSTQNNEKWPDRLVASLRPIHKYSRACIGAGYMVGPSVFLGTPGVVSYYLTKFVKGGAQVLPETVFSTGRIEVDCREYLDDREREVAASLPHGFIGDVKGTTVGGCHHVTSRYLPRVLPKESVAVVGVSSPGKAAKALCTLTDVYLPDLEAYLHPETQSKCWKMMLDFKEVRLMVWKDKTAYFQLE

SEQ ID NO: 132 - protein, 153 aa, Porcine reproductive and respiratory syndrome virus
GRYFTWYQLASYASYIRVPVNSTVYLDPCMGPALCNRRVVGSTHWGADLAVTPYDYGAKIILSSAYHGEMPPGYKILACAEFSLDDPVKYKHTWGFESDTAYLYEFTGNGEDWEDYNDAFRARQEGKIYKATATSLKFYFPPGPVIEPTLGLN

SEQ ID NO: 133 - protein, 2503 aa, Porcine reproductive and respiratory syndrome virus
MSGILDRCTCTPNARVFMAEGQVYCTRCLSARSLLPLNLQVSELGVLGLFYRPEEPLRWTLPRAFPTVECSPAGACWLSAIFPIARMTSGNLNFQQRMVRVAAELYRAGQLTPAVLKALQVYERGCRWYPIVGPVPGVAVFANSLHVSDKPFPGATHVLTNLPLPQRPKPEDFCPFECAMATVYDIGHDAVMYVAERKVSWAPRGGDEVKFEAVPGELKLIANRLRTSFPPHHTVDMSKFAFTAPGCGVSMRVERQHGCLPADTVPEGNCWWSLFDLLPLEVQNKEIRHANQFGYQTKHGVSGKYLQRRLQVNGLRAVTDLNGPIVVQYFSVKESWIRHLKLAGEPSYSGFEDLLRIRVEPNTSPLADKEEKIFRFGSHKWYGAGKRARKARSCATATVAGRALSVRETRQAKEHEVAGANKAEHLKHYSPPAEGNCGWHCISAIANRMVNSKFETTLPERVRPPDDWATDEDLVNAIQILRLPAALDRNGACTSAKYVLKLEGEHWTVTVTPGMSPSLLPLECVQGCCGHKGGLGSPDAVEVSGFDPACLDRLAEVMHLPSSAIPAALAEMSGDSDRSASPVTTVWTVSQFFARHSGGNHPDQVRLGKIISLCQVIEDCCCSQNKTNRVTPEEVAAKIDLYLRGATNLEECLARLEKARPPRVIDTSFDWDVVLPGVEAATQTIKLPQVNQCRALVPVVTQKSLDNNSVPLTAFSLANYYYRAQGDEVRHRERLTAVLSKLEKVVREEYGLMPTEPGPRPTLPRGLDELKDQMEEDLLKLANAQTTSDMMAWAVEQVDLKTWVKNYPRWTPPPPPPKVQPRKTKPVKSLPERKPVPAPRRKVGSDCGSPVSLGGDVPNSWEDLAVSSPFDLPTPPEPATPSSELVIVSSPQCIFRPATPLSEPAPIPAPRGTVSRPVTPLSEPIPVPAPRRKFQQVKRLSSAAAIPPYQDEPLDLSASSQTEYEASPPAPPQSGGVLGVEGHEAEETLSEISDMSGNIKPASVSSSSSLSSVRITRPKYSAQAIIDSGGPCSGHLQEVKETCLSVMREACDATKLDDPATQEWLSRMWDRVDMLTWRNTSVYQAICTLDGRLKFLPKMILETPPPYPCEFVMMPHTPAPSVGAESDLTIGSVATEDVPRILEKIENVGEMANQGPLAFSEDKPVDDQLVNDPRISSRRPDESTSAPSAGTGGAGSFTDLPPSDGADADGGGPFRTVKRKAERLFDQLSRQVFDLVSHLPVFFSRLFYPGGGYSPGDWGFAAFTLLCLFLCYSYPAFGIAPLLGVFSGSSRRVRMGVFGCWLAFAVGLFKPVSDPVGAACEFDSPECRNILHSFELLKPWDPVRSLVVGPVGLGLAILGRLLGGARCIWHFLLRLGIVADCILAGAYVLSQGRCKKCWGSCIRTAPNEVAFNVFPFTRATRSSLIDLCDRFCAPKGMDPIFLATGWRGCWAGRSPIEQPSEKPIAFAQLDEKKITARTVVAQPYDPNQAVKCLRVLQAGGAMVAKAVPKVVKVSAVPFRAPFFPTGVKVDPDCRVVVDPDTFTAALRSGYSTTNLVLGVGDFAQLNGLKIRQISKPSGGGPHLMAALHVACSMALHMLAGIYVTAVGSCGTGTNDPWCANPFAVPGYGPGSLCTSRLCISQHGLTLPLTALVAGFGIQEIALVVLIFVSIGGMAHRLSCKADMLCVLLAIASYVWVPLTWLLCVFPCWLRCFSLHPLTILWLVFFLISVNMPSGILAMVLLVSLWLLGRYTNVAGLVTPYDIHHYTSGPRGVAALAIAPDGTYLAAVRRAALTGRTMLFTPSQLGSLLEGAFRTRKPSLNTVNVIGSSMGSGGVFTIDGKVKCVTAAHVLTGNSARVSGVGFNQMLDFDVKGDFAIADCPNWQGAAPKTQFCTDGWTGRAYWLTSSGVEPGVIGKGFAFCFTACGDSGSPVITEAGELVGVHTGSNKQGGGIVTRPSGQFCNVAPIKLSELSEFFAGPKVPLGDVKVGSHIIKDISEVPSDLCALLAAKPELEGGLSTVQLLCVFFLLWRMMGHAWTPLVAVSFFILNEVLPAVLVRSVFSFGMFVLSWLTPWSAQVLMIRLLTAALNRNRWSLAFFSLGAVTGFVADLAATQGHPLQAVMNLSTYAFLPRMMVVTSPVPVITCGVVHLLAIILYLFKYRGPHHILVGDGVFSAAFFLRYFAEGKLREGVSQSCGMNHESLTGALAMRLNDEDLDFLMKWTNFKCFVSASNMRNAAGQFIEAAYAKALRVELAQLVQVDKVRGTLAKLEAFADTVAPQLSPGDIVVALGHTPVGSIFDLKVGSTKHTLQAIETRVLAGSKMTVARVVDPTPTPPPAPVPIPLPPKVLENGPNAWGDEDRLNKKKRRRMEALGIYVMGGKKYQKFWDKNSGDVFYEEVHNNTDEWECLRVGDPADFDPEKGTLCGHVTIENKAYHVYTSPSGKKFLVPVNPENGRVQWEAAKLSVEQALGMMNVDGELTAKELEKLKRIIDKLQGLTKEQCLNC

SEQ ID NO: 134 - protein, 1452 aa, Porcine reproductive and respiratory syndrome virus
LAASDLTRCGRGGLVVTETAVKIVKFHNRTFTLGPVNLKVASEVELKDAVEHNQHPVARPIDGGVVLLRSAVPSLIDVLISGADASPKLLAHHGPGNTGIDGTLWDFESEATKEEVALSAQIIQACDIRRGDAPEIGLPYKLYPVRGNPERVKGVLQNTRFGDIPYKTPSDTGSPVHAAACLTPTDGRSVLATTMPPGFELYVPTIPASVLDYLDSRPDCPKQLTEHGCEDAALKDLSKYDLSTQGFVLPGVLRLVRKYLFAHVGKCPPVHRPSTYPAKNSMAGINGNRFPTKDIQSVPEIDVLCAQAVRENWQTVTPCTLKKQYCGKKKTRTILGTNNFIALAHRAVLSGVTQGFMKKAFNSPIALGKNKFKELQTPVLGRCLEADLASCDRSTPAIVRWFAANLLYELACAEEHLPSYVLNCCHDLLVTQSGAVTKRGGLSSGDPITSVSNTIYSLVIYAQHMVLSYFKSGHPHGLLFLQDQLKFEDMLKVQPLIVYSDDLVLYAESPTMPNYHWWVEHLNLMLGFQTDPKKTAITDSPSFLGCRIINGRQLVPNRDRILAALAYHMKASNVSEYYASAAAILMDSCACLEYDPEWFEELVVGIAQCARKDGYSFPGTPFFMSMWEKLRSNYEGKKSRVCGYCGAPAPYATACGLDVCIYHTHFHQHCPVTIWCGHPAGSGSCSECKSPVGKGTSPLDEVLEQVPYKPPRTVIMHVEQGLTPLDPGRYQTRRGLVSVRRGIRGNEVELPDGDYASTALLPTCKEINMVAVASNVLRSRFIIGPPGAGKTYWLLQQVQDGDVIYTPTHQTMLDMIRALGTCRFNVPAGTTLQFPVPSRTGPWVRILAGGWCPGKNSFLDEAAYCNHLDVLRLLSKTTLTCLGDFKQLHPVGFDSHCYVFDIMPQTQLKTIWRFGQNICDAIQPDYRDKLMSMVNTTRVTYVEKPVRYGQVLTPYHRDREDDAITIDSSQGATFDVVTLHLPTKDSLNRQRALVAITRARHAIFVYDPHRQLQGLFDLPAKGTPVNLAVHRDGQLIVLDRNNKECTVAQALGNGDKFRATDKRVVDSLRAICADLEGSSSPLPKVAHNLGFYFSPDLTQFAKLPVELAPHWPVVTTQNNEKWPDRLVASLRPIHKYSRACIGAGYMVGPSVFLGTPGVVSYYLTKFVKGEAQVLPETVFSTGRIEVDCREYLDDREREVAASLPHAFIGDVKGTTVGGCHHVTSRYLPRVLPKESVAVVGVSSPGKAAKALCTLTDVYLPDLEAYLHPETQSKCWKMMLDFKEVRLMVWKDKTAYFQLEGRYFTWYQLASYASYIRVPVNSTVYLDPCMGPALCNRRVVGSTHWGADLAVTPYDYGAKIILSSAYHGEMPPGYKILACAEFSLDDPVKYKHTWGFESDTAYLYEFTGNGEDWEDYNDAFRARQEGKIYKATATSLKFYFPPGPVIEPTLGLN

SEQ ID NO: 135 - protein, 70 aa, Porcine reproductive and respiratory syndrome virus
MGSLWSKISQLFVDAFTEFLVSVVDIVIFLAILFGFTVAGWLLVFLLRVVCSALLRSRSAIHSPELSKVL

SEQ ID NO: 136 - protein, 256 aa, Porcine reproductive and respiratory syndrome virus
MKWGPCKAFLTKLANFLWMLSRSSWCPLLISLYFWPFCLASPSPVGWWSFASDWFAPRYSVRALPFTLSNYRRSYEAFLSQCQVDIPTWGTKHPLGMLWHHKVSTLIDEMVSRRMYRIMEKAGQAAWKQVVSEATLSRISSLDVVAHFQHLAAIEAETCKYLASRLPMLHNLRMTGSNVTIVYNSTLNQVFAIFPTPGSRPKLHDFQQWLIAVHSSIFSSVAASCTLFVVLWLRVPILRTVFGFRWLGAIFLSNSQ

SEQ ID NO: 137 - protein, 254 aa, Porcine reproductive and respiratory syndrome virus; identical to SEQ ID NO: 11

SEQ ID NO: 138 - protein, 178 aa, Porcine reproductive and respiratory syndrome virus
MASSLLFLVVGFKCLLVSQAFACKPCFSSSLADIKTNTTAAASFAVLQDISCLRHRDSASEAIRKIPQCRTAIGTPVYVTITANVTDENYLHSSDLLMLSSCLFYASEMSEKGFKVVFGNVSGIVAVCVNFTSYVQHVKEFTQRSLVVDHVRLLHFMTPETMRWATVLACLFAILLAI

SEQ ID NO: 139 - protein, 200 aa, Porcine reproductive and respiratory syndrome virus
MLEKCLTAGCCSRLLSLWCIVPFCFAVLANASNDSSSHLQLIYNLTLCELNGTDWLANKFDWAVESFVIFPVLTHIVSYGALTTSHFLDTVALVTVSTAGFVHGRYVLSSIYAVCALAALTCFVIRFAKNCMSWRYACTRYTNFLLDTKGRLYRWRSPVIIEKRGKVEVEGHLIDLKRVVLDGSVATPITRVSAEQWGRP

SEQ ID NO: 140 - protein, 51 aa, Porcine reproductive and respiratory syndrome virus
MFKYVGEMLDRGLLLAIAFFVVYRAVLFCCARQRQQRQQLPSTADLQLDAM

SEQ ID NO: 141 - protein, 174 aa, Porcine reproductive and respiratory syndrome virus
MGSSLDDFCHDSTAPQKVLLAFSITYTPVMIYALKVSRGRLLGLLHLLIFLNCAFTFGYMTFAHFQSTNKVALTMGAVVALLWGVYSAIETWKFITSRCRLCLLGRKYILAPAHHVESAAGFHPIAANDNHAFVVRRPGSTTVNGTLVPGLKSLVLGGRKAVKQGVVNLVKYAK

SEQ ID NO: 142 - protein, 123 aa, Porcine reproductive and respiratory syndrome virus
MPNNNGKQQKRKKGDGQPVNQLCQMLGKIIAQQNQSRGKGPGKKNKKKNPEKPHFPLATEDDVRHHFTPSERQLCLSSIQTAFNQGAGTCTLSDSGRISYTVEFSLPTHHTVRLIRVTASPSA

SEQ ID NO: 143 - protein, 314 aa, Porcine circovirus
MPSKKNGRSGPQPHKRWVFTLNNPSEDERKKIRELPISLFDYFIVGEEGNEEGRTPHLQGFANFVKKQTFNKVKWYLGARCHIEKAKGTDQQNKEYCSKEGNLLMECGAPRSQGQRSDLSTAVSTLLESGSLVTVAEQHPVTFVRNFRGLAELLKVSGKMQKRDWKTNVHVIVGPPGCGKSKWAANFADPETTYWKPPRNKWWDGYHGEEVVVIDDFYGWLPWDDLLRLCDRYPLTVETKGGTVPFLARSILITSNQTPLEWYSSAAVPAVEALYRRITSLVFWKNATEQSTEEGGQFVTLSPPCPEFPYEINY

SEQ ID NO: 144 - protein, 104 aa, Porcine circovirus
MVTIPPLVSRWFPVCGFRVCKISSPFAFATPRWPHNDVYIRLPITLLHFPAHFQKFSQPAEISDKRYRVLLCNGHQTPALKQGTHSGRQVTPLSLRSRSSTFHQ

SEQ ID NO: 145 - protein, 59 aa, Porcine circovirus
MTCTFVFQSRFCIFPLTFKSSASPRKFLTNVTGCCSATVTRLPLSSKVLTAVDRSLRCP

SEQ ID NO: 146 - protein, 59 aa, Porcine circovirus
MYTSLWGHLGVAKANGLLILQTRKPHTGNHLETSGGMVTMVKKWLLLMTFMAGCRGMIY

SEQ ID NO: 147 - protein, 21 aa, Porcine circovirus
MDTDHTVSVDHPTAASHKSHQ

SEQ ID NO: 148 - protein, 14 aa, Porcine circovirus
MNNKNHYEVIKKTQ

SEQ ID NO: 149 - protein, 53 aa, Porcine circovirus
MVFIIHLGFKWGVFKIKFSELYIHGYTDIVVLVVYTVFERSAEAYMVYISSSL

SEQ ID NO: 150 - protein, 159 aa, Porcine circovirus
MTFPRRRYRRRRHRPRSHLGQILRRRPWFLHPRHRYRWRRKNGIFNTRLSRTFGYTVKATTVRTPSWAVDMLRFKIDDFVPPGGGTNKISIPFEYYRIRKVKVEFWPCSPITQGDRGVGSSAVILDDNFFPKSTALTYDPYVNYSSRHTITQPFSYHSR

SEQ ID NO: 151 - protein, 35 aa, Porcine circovirus
MSTAQEGVLTVVALTVYPKVRERRVLKMPFFLLQR

SEQ ID NO: 152 - protein, 27 aa, Porcine circovirus
MASSTPASPAPSDILSRLPQSERPPGR

SEQ ID NO: 153 - protein, 19 aa, Porcine circovirus
MAAGAVSSSAVTPPWKRHS

SEQ ID NO: 154 - DNA, 1768 bp, Porcine circovirus
accagcgcacttcggcagcggcagcacctcggcagcacctcagcagcaacatgcccagcaaaaagaatggaagaagcggaccccaaccacacaaaaggtgggtgttcacgctgaataatccttccgaagacgagcgcaagaaaatacgggagcttccaatctccctttttgattattttattgttggcgaggagggtaatgaggaaggacgaacaccccacctccaggggttcgctaattttgtgaagaagcaaacatttaataaagtgaaatggtatttgggtgcccgctgccacatcgagaaagccaaaggaactgatcagcagaataaagaatattgcagtaaagaaggcaacttactgatggaatgtggagctcctagatctcaaggacaacggagtgacctgtctaccgctgtgagtaccttgcttgagagcgggagtctggtgaccgttgcagagcagcaccctgtaacgtttgtcagaaatttccgcgggctggctgaacttttgaaagtgagcgggaaaatgcagaagcgtgattggaagacgaatgtacacgtcattgtggggccacctgggtgtggcaaaagcaaatgggctgctaattttgcagacccggaaaccacatactggaaaccacctagaaacaagtggtgggatggttaccatggtgaagaagtggttgttattgatgacttttatggctggctgccgtgggatgatctactgagactgtgtgatcggtatccattgactgtagagactaaaggtggaactgtaccttttttggcccgcagtattctgattaccagcaatcagaccccgttggaatggtactcctcggctgctgtcccagctgtagaagctctctatcggaggattacttccttggtattttggaagaatgctacagaacagtccacggaggaagggggccagttcgttaccctttcccccccatgccctgaatttccatatgaaataaattactgagtcttttttatcacttcgtaatggtttttattattcatttagggtttaagtggggggtctttaagattaaattctctgaattgtacatacatggttacacggatattgtagtcctggtcgtatatactgttttcgaacgcagtgccgaggcctacatggtctacatttccagtagtttgtagtctcagccagagttgatttcttttgttattgggctggaagtaatcgattgtcgaatcaaggacaggtttgggtgtgaattaacgggagtggtaggaaaagggttgggttatggtatggcgggaggagtagtttacataggggtcataggttagggctgtgctctttgggaaaaagttatcatctagaataacagcactggatccaactcccctgtcaccctgggtgattggggagcagggccagaattcaaccttaacctttcttattctgtagtattcaaagggtatagagattttgttggtcccccctcccgggggaacaaagtcgtctattttaaatctcagcatgtctaccgcccaggagggcgttctgactgtggtagccttgacagtatatccgaaggtgcgggagaggcgggtgttgaagatgccatttttccttctccagcggtaacggtggcgggggtggaggaaccaggggcggcggcggaggatctggccaagatggctgcgggggcggtgtcttcgtctgcggtaacgcctccttggaaacgtcatagctgaaaacgaaagaagtgcgctgtaagtatt

SEQ ID NO: 155 - protein, 296 aa, Porcine circovirus
VRRESPKHRWCFTINNWTPTEWESIVECGGSIARYLIIGKEVGKSGTPHLQGYVNFKNKRRLSSVKRLPGFGRAHLEPARGSHKEASEYCKKEGDYLEIGEDSSSGTRSDLQAAARILTETSGNLTEVAEKMPAVFIRYGRGLRDFCGVMGLGKPRDFKTEVYVFIGPPGCGKTREACADAAARELQLYFKPRGPWWDGYNGEGAVILDDFYGWVPFDELLRIGDRYPLRVPVKGGFVNFVAKVLYITSNVVPEEWYSSENIRGKLEALFRRFTKVVFWGEGGVKKDMETVYPINY

SEQ ID NO: 156 - protein, 214 aa, Porcine circovirus
MRHRAIFRRRPRPRRRRRHRRRYARRRLFIRRPTAGTYYTKKYSTMNVISVGTPQNNKPWHANHFITRLNEWETAISFEYYKILKMKVTLSPVISPAQQTKTMFGHTAIDLDGAWTTNTWLQDDPYAESSTRKVMTSKKKHSRYFTPKPILAGTTSAHPGQSLFFFSRPTPWLNTYDPTVQWGALLWSIYVPEKTGMTDFYGTKEVWIRYKSVL

SEQ ID NO: 157 - protein, 2000 aa, Porcine circovirus
TAGTATTACCCGGCACCTCGGAACCCGGATCCACGGAGGTCTGTAGGGAGAAAAAGTGGTATCCCATTATGGATGCTCCGCACCGTGTGAGTGGATATACCGGGCAGTGGATGATGAAGCGGCCTCGTGTTTTGATGCCGCAGGACGGGGACTGGATAACTGAGTTTTTGTGGTGCTACGAGTGTCCTGAAGATAAGGACTTTTATTGTCATCCTATTCTAGGTCCGGAGGGAAAGCCCGAAACACAGGTGGTGTTTTACGATAAACAACTGGACCCCGACCGAGTGGGAATCTATTGTGGAGTGTGGAGGCAGTATAGCGAGATACCTTATTATCGGCAAAGAGGTTGGAAAAAGCGGTACCCCACACTTGCAAGGGTACGTGAATTTCAAGAACAAAAGGCGACTCAGCTCGGTGAAGCGCTTACCCGGATTTGGTCGGGCCCATCTGGAGCCGGCGAGGGGGAGCCACAAAGAGGCCAGCGAGTACTGCAAGAAAGAGGGGGATTACCTCGAGATTGGCGAAGATTCCTCTTCGGGTACCAGATCGGATCTTCAAGCAGCAGCTCGGATTCTGACGGAGACGTCGGGAAATCTGACTGAAGTTGCGGAGAAGATGCCTGCAGTATTTATACGCTATGGGCGGGGTTTGCGTGATTTTTGCGGGGTGATGGGGTTGGGTAAACCGCGTGATTTTAAAACTGAAGTTTATGTTTTTATTGGTCCTCCAGGATGCGGGAAAACGCGGGAAGCTTGTGCGGATGCGGCTGCGCGGGAATTGCAGTTGTATTTCAAGCCACGGGGGCCTTGGTGGGATGGTTATAATGGGGAGGGTGCTGTTATTCTGGATGATTTTTATGGGTGGGTTCCATTTGATGAATTGCTGAGAATTGGGGACAGGTACCCTCTGAGGGTTCCTGTTAAGGGTGGGTTTGTTAATTTTGTGGCTAAGGTATTATATATTACTAGTAATGTTGTACCGGAGGAGTGGTATTCATCGGAGAATATTCGTGGAAAGTTGGAGGCCTTGTTTAGGAGGTTCACTAAGGTTGTTTTTTGGGGGGAGGGGGGGGTAAAGAAAGACATGGAGACAGTGTATCCAATAAACTATTGATTTTATTTGCACTTGTGTACAATTATTGCGTTCGGGAGGGGGTATTTATTGGGTGGGTGGGTGGGCAGCCCCCTAGCCACGGCTTGTCGCCCCCACCGAAGCATGTGGGGGATGGGGTCCCCACATGCGAGGGCGTTTACCTGTGCCCGCACCCGAAGCGCAGCGGGAGCGCGCGCGAGGGGACACGGCTTGTCGCCACCGGAGGGGTCAGATTTATATTTATTTTCACTTAGAGAACGGACTTGTAACGAATCCAAACTTCTTTGGTGCCGTAGAAGTCTGTCATTCCAGTTTTTTCCGGGACATAAATGCTCCAAAGTAGTGCTCCCCATTGAACGGTGGGGTCATATGTGTTGAGCCATGGGGTGGGTCTGGAGAAAAAGAAGAGGCTTTGTCCTGGGTGAGCGCTGGTAGTTCCCGCCAGAATTGGTTTGGGGGTGAAGTAACGGCTGTGTTTTTTTTTAGAAGTCATAACTTTACGAGTGGAACTTTCCGCATAAGGGTCGTCTTGGAGCCAAGTGTTTGTGGTCCAGGCGCCGTCTAGATCTATGGCTGTGTGCCCGAACATAGTTTTTGTTTGCTGAGCTGGAGAAATTACAGGGCTGAGTGTAACTTTCATCTTTAGTATTTTGTAATATTCAAAGCTAATTGCAGTTTCCCATTCGTTTAGGCGGGTAATGAAGTGGTTGGCGTGCCAGGGCTTATTATTCTGAGGGGTTCCAACGGAAATGACGTTCATGGTGGAGTATTTCTTTGTGTAGTATGTGCCAGCTGTGGGCCTCCTAATGAATAGTCTTCTTCTGGCATAGCGCCTTCTGTGGCGTCGGCGTCTCCTTGGGCGGGGTCTTCTTCTGAATATAGCTCTGTGTCTCATTTTGGTGCCGGGC

SEQ ID NO: 158 - protein, 202 aa, Equine herpesvirus 1
MRPEGVSRGRASSVSISMCPPPPNGARRASLGCAPPLNSRPVCCAPSSVSLSSSSSRRSMPSLGSSRSSSLPSTGSLRSITRDPERLPSRPPSYTAINPECLLERGAERPRAWTASVMTAPPSYSEALCQAPPAYELVPELSYHPTQDPRGVYSSRSDPHQTSRRRQNPICIFIIVVATMLLILGLLLTITLSSLTNGKKEK

SEQ ID NO: 159 - protein, 205 aa, Equine herpesvirus 1
MDPAWRRRIHVSNPTTINVEPRPRRESLRRQLLSQLFFKKMSQLFKKKRQTRPSTVWYGRVAFPPSAWQGPARVSPYGYESDSENEEYTRISSATSSNVLTDSPTTTQDDPTGRCTDAYAESPAVLHLDDVTRNHRGAAALPSEVYLDGFCDQHKDPSGRMGPIKRRLYSKTFCRKFAAINIILLMLQILVLIGIVYRGFGKECM

SEQ ID NO: 160 - protein, 257 aa, Equine herpesvirus 1
MGACCSSRRNRSPSLAALAEETEVVLRCLAGRVVDLPGGDEVRIAPDVGRPGQNFGYFKFPGPSRFAYVKFIGRAYALGSGRKFLLYLSRNFQVFGYEDGTGLHMLAKSLHDFLKFKGLSDRDLVVVDSVALTSQLRPLTLPIRSTSDVETLVAEEATTNYTSTENLLGQTQSSTHRPLGVPLSNVKTMGVPPTKPSSQRPRGKGGRPPARLKSIREETVSGMARAREECNSPSEHDRLTSEMTDCDSDSSVSSVFF

SEQ ID NO: 161 - protein, 200 aa, Equine herpesvirus 1
MLPANRAEHSSDAEPRDIGSHGRNHGGCYSSDCKLGLLVDISNVVSPLPLDLTWSSWETTSQPARSRSYLNTRTYTIRACCDLQTRLHAFFIGVFEKRDPEKQILLPDLTNFKCILNNPRIMQELATEHSVCSAPFSAATQYDCDEDGEESTINGLCFHCHCKTPFSLECWQAANSAQAKILSVARGITSAKERQRENKR

SEQ ID NO: 162 - protein, 470 aa, Equine herpesvirus 1
MALSSVSSCEPMEDEMSIMGSDTEDNFTGGDTCAEATRGLVNKSAFVPTQTVGTVSALRNVVGDPPKSVVVSFSASPQRAQPSNPKSERPAFGHGRRNRRRPFRRNNWKQQQRGWEKPEPENVPARQSAGSWPKRSSLPVHMRLGQRGGDSSSADSGHGGAGPSDRWRFKTRTQSVARVHRNRRRGNANHGSNTPGRSAGDRLNAAAASSIADVCRRVTSSRIGEMFHGARETLTTPVKNGGFRAENSSPWAPVLGFGSDQFNPEARRITWDTLVEHGVNLYKLFEVRSHAAEAARSLRDAVMRGENLLEALASADETLSWCKMIVTKNLPMRTRDPIISSSVALLDNLRLKLEPFMRCYLSSSGSPTLAELCDHQRLSDVACVPTFMFVMLARIARAVGSGAETVSRDALGPDGRVLADYVPGACLAGTLEAIDAHKRRCKADTCSLVSAYTLVPVYLHGKYFYCNQIF

SEQ ID NO: 163 - protein, 343 aa, Equine herpesvirus 1
MLLGGRTAYLSVLGLITAYAAFTIWYTLTAQLHNPCVYATVSIDSKDGIAAKWEVYNSTIVYAYPENGAKRFSDGLSGFDYVCRENWVNESKLDVLKNMKELHDKVRIVVGTRNCRAYLWSVQLQMITGAWLIYIAFLCLRQERRLLGPFRNQNEFLSPTGYTFNYATYTLATTVLKTHYTKFALLLCEASLRRVALSRTFKRDPIGFLCEHSAALALIGLEVGTHFVARLLVVGTVTLVHTPCSQIYPIYLKLASWGFVVAVTIVEIVAIIYEKPPKTGSSANPPTPATHGVKGLCTSCCSTVLANLCGKLVYLLLVIGAVSILLHYEQRIQIGLLGESFSS

SEQ ID NO: 164 - protein, 1081 aa, Equine herpesvirus 1
MAQRNPEPTIRVLYATDSCVITYSLMLLTGQESSEGVYAISYDWSSELDDLFGRQPRAPNTDAGDGWSSTEQSDADQLATALLQRKPSVSFCLLSGMVGGASDEPQDRVRPMFVCVFSTWTGARALAMTLSHGHPLSSNTLLQALTEEATFLLHNDLILALAITTENVTARSGRTAAAAKYDPQRGSVKAAVIGHSTGRSGLTSVYIHHENKVLTAFRRLYCNNNTTPFWFASKFGPGEREIVLATRYYLFQAIRCSRSGGTYDLQAVKDFIRTYNVPAAPNPTGLDLTHLTSFSLLSKFCCQSWYSRGPCALALPRYVDLRIQADVAEVSALEGFIAADRQGLRVSDREFITYIYLAHFESFNRKQLYDHLLAVSIADPGDIDRITSTSSLKRGTIEKFFAQVRIQLNIRDYIAHNVNPRVVCLPASIGSQYAQDKTYTPSSTTMSTGSAPLGVCDTSTPILKLLDRVESSLAGRGWIQTIVSPNKPQSVHSTPPLDQSRGDELSPGVSSQCGISRRLLHIASSPPVNGRALPLEVLFGQKGVPGPAPVYRVALPSKRQAFAVIANDRWETTTQNLARPGGSKQAYEGGFALAGFGEIDDCSLAWRDLQLTRTTSGVCRTALASSNASAQMYINRNEIFNSSLAVSNIILDVDFGIKRRVPLGMLHLAMRGFRAGIITTLSLIFSDATVQWDSYPCYFYKTSCPPQLVRALHRGEPSSFPDYVDGVEECYMESDFIDDYAAMEEYTDGPMDDYEMMMVDNECPQAACDNTPPNKEGGKTPLQRLDDTDACECTEKMGFRVTVPVPPPYLLAGPEALRGLARIIQQAVVLERTFTESMCSVLRDFSFIDTGVYSHGRSLRLPFFCKVGDSGEVYGGLYPFYVIPPKCNDVDEFVAQHSNPANFHFHAAPRHPTITHVITDLGGDYVSFFERKVARNREAIMTKRATLESLLSSANVSIKSHEAVEAFVVDVVLGEVVSHLATHFPDQSGEYQTVGVHTVVTKPDWILMQINRSGNAYRSQGFSCLRAKHLRSARGLARTFLSISADVHGRLCASISQQCFATKCGNNKMCTIFTLEVDRAK

SEQ ID NO: 165 - protein, 245 aa, Equine herpesvirus 1
MFKWLMSSLCGIRNSTSPEVYEPIIGGQNPATMLRLQSALAAVNALLPATLTIEDVISSADNTRRLVKAQTLARTYQACQHNIECLSRHRASSDNPNLNAVVTTHMINAKRLSDTCLAALMHLYLSVGAVDATTDTMVDHAIRMTAENSVVMADVAVLEKTLGLDPQATVRAQDLLALNSGVLNSVNAVAEMTDPTDDVEFTQSVHSPLLPRQLSTTEVVGVPSPVKSNLKSKHKPKRKASLVAV

SEQ ID NO: 166 - protein, 326 aa, Equine herpesvirus 1
MASVTNLVDSIVVVECGERWRARAEAAGRLLVLINNHTVELSGEHGSAGEFYSVLTDVGVRVACSSGYAIVLTQISGLLPVEPEPGNFSNVTFPENSAKYYTAYGIVDSGYRGVVKAVQFAPGINTSVPPGQMSLGLVLVKLARKSIHVTSIGSTRDGRTSEANLFYDYFAPKRVEDAGYDISAPEDATIDPDESHFVDLPIVFANSNPAVTPCIFGRSSMNRRGLIVLPTRWVAGRTCCFFILNVNKYPVSITKGQRVAQLLLTEDIDDALIPPTVNYDNPFPTYSPSESTKAPQSPVLWKFTTDFDREAPSSLRADGGFGSTGL

SEQ ID NO: 167 - protein, 100 aa, Equine herpesvirus 1
MLSTRFVTLAILACLLVVLGLARGAGGDPGVKQRIDVAREEERRDFWHAACSGHGFPITTPSTAAILFYVSLLAVGVAVACQAYRAVLRIVTLEMLQHLH

SEQ ID NO: 168 - protein, 304 aa, Equine herpesvirus 1
MSDTWRRRRSGCNDANATEELVYSTVRSDHRQRRPSRGTFVMRENDLYDKQSVSKENDLYESASPNDDKVYTRRGMSTAAHYRDSEHIYETCEGDEFYDACEYSLIGGGKLSTSNGRQSPAKAQPPPRGAAAAPPPRVPTRPPTRAAATSTTPRQQDCAPKQRASPGVNSIKSGKGLAFSGTPKTPKSQWYGATHLFNKNVFCAAVSRVAAAHASDAASALWDLNPPKTNEDLDRFLKAAAIRILVCEGAQLLEVANSTMESTPDGYAAAGPNGYDRRPRTASRRRSLKCKPPADDFFDDTNSG

SEQ ID NO: 169 - protein, 479 aa, Equine herpesvirus 1
MCLLHISLPYLSCALLPGWYFDARPAASIVMFAAAEENDDPYPGKSGYNDTCELMDMDGAVASFDEGMLSAIESVYSIPTKKRLALPPPKAASPGALYQRLQGELGFPEGQTLLSAMEKWNEDMFSALPGHVDLYTEIALLSTSVDEVVRAGLDSLPTPSHYSPEVDLNAHGDEPFPEVPALEDDLEIYVISAQRFYLSELRTREEHYARLLRGYCVALLHYLYGSAKRQLRGSGSDASLMHKFKQVVRDRYYREAANLARLLYLHLYVSVTREVSWRLHASQVINQGVFVSLHYFWAQRRKFECLFHPVLFNHGVVILENDPLEFHDLQRINYRRRELGLPLIRAGLIEEENSPLEAEPLFSGKLPRTIGFLTHQIRTKMEAYSDAHPATPLFPLAEHSYSKRIGGRLSYGTTTEAMMDPPSPSAVLPGDPVPPLTVGVRQTAATLAIPSNLTLQSMETDGLDYSSMTGDELNQMFDI

SEQ ID NO: 170 - protein, 871 aa, Equine herpesvirus 1
MDQHHGARGGAPIRRPRRSIESRSHPFRATGNTQRTYSTPRLSYRDGLSGRTASRDPQEQASNQDESSNPSTSNAQQSTSFWGYLRRVFSDDVPAQPQAPRPRADFAPPAGEESSSEEEEEEGPAQAPLDEEDQLMYADQYSVGDSSDENDEEEDPRLGSDYPTSAESSEYHDHGEMVAGAGAESESETDIDAEEEEEDDEDDEDDMEVIRDESYRLPRTWLDKSIRLMDEALAQSSELSKAITKSTRSLYDSQFAPGGRGYTQTATPSRRLVQLSRAGMYDSDKIVMTGDYMEVDDDPDSAYQSWVRAIRHPLAMNPSWEETISNHTNPSFSTDIDYDIDELIEKNLARTPPVFEGLLDSAEFFYKLPMLYTYATITQDEAYEERLAWSNTQALHGHEQSSWQALLVYYSRGGMYVSPTQEPRGIWRRALKQAMALQLKMCVLGLSDVVTKQNATHHHAAVTFLVDALLRTARNCYLASRLLVFAWERRRETGAKRPAEPLIALSGVTLLQPLPPEVSELLEQRTFDIGLRTPNSAVFRAFFGSLVYWAELRLALRDPASINCRYVGFHLQTSEIYLLARAHSASPGYTKEELVAMEAILTLATLMLEVALQWVHVACAQLLSENDTIKAFRRVSASIPHALAPLGSIRLHDAEFEVLSNPDVMVARDETALSQALFLGYFSVRTALTACMRDYSHEADGGSKETVTGVFLGVGLILQRLAGHLNFLLNCLAGAALYGGQKINIHSLTLPRYSLLADVMAPMLQRQSLVDFWRARDNMLEDLEITPRPGPPTQGKRVVVEMPLPSDDLPDMTPGASVNNGAGLGRMVDMAKQLQHYRETIIGEEATSSVGKRGLIRAGVGVAALRGRRRK

SEQ ID NO: 171 - protein, 747 aa, Equine herpesvirus 1
MDGGGSSSWTHVSKNLIERRAVKGCLLPTPSDVMDAAVMALKDVTENIVGQQLFSVDRTNALSVIHTNEVPESIIATAIARDTSRDYLREYEGAAKCNLAATDLSHDEMWEVVIKRYWRYLRESSGAEVVDRGAVGQATQSVLSVLLLQSTFGKKRLSKNPFKHKGPNVGYKSNLEDLRSAFTKIEKYMYYMRPNDPMTKSEDTELRLHELLAYVTTCYRWLLWFMDLTDAKVLRNIDKGPVITHGPRESRPPDELVRRHLKSGPAISAGTGVALTLSTATADALIVLLRMSVSWTSHSWKSNTHGVTGAIVAAVELVTLIHHHLQYIINTVFAGYVCWLDGGVENSYLNSALRSQGRFDHFVGKLVPIMATLSWANMEKGTVMWFKYALAKSIVCHGSPTQHYLTVLESIASKRTGACPPQGSTFGRNPSGFPGQFCCPPQGPLPAPPNSKTRGTFRRCRPGSLRSSRQLPTSPPSNIVSPRTNPAIEGSTAAKNVQGAETIQVRSSGEFNDCIWYINGAYPHQRSDSSSSDNSTCSSTETQYITLPSTPSPTGDVVYTNPLLGPDEEVDASPQPVDPMSDYSAPKNPDYMRPRSTLVEEVWQLRDSDYTPYMRPSRAGRSRVRVEDQTLEPSSPAGCNPPANSPENDSDDAAVDSPPISPEVVYGTFRPRAKCVYDQYGLTALAALSASRAKARRTRPGPTQPDVCRERDEESAEPRHDGFIRRTMSTTGPPRKHPDQTERVSSL

SEQ ID NO: 172 - protein, 219 aa, Equine herpesvirus 1
MEDYKLLQLETATVDAQAPPLPTKTVPVFAPPLSTPPQPNELVYTKRRRTKRKAKCRCLFFTMGMFALGVLMTTAILVSTFILTVPIGALRTAPCPAETFGLGDECVRPVLLNASSNTRNISGVGAVCEEYSEMAASNGTAGLIMSLLDCLNVGDSESVMNKLNLDDTQLAYCNVPSFAECYTKGFGVCYAARPLSPLGELIYKARQALRLDHIIPFPR

SEQ ID NO: 173 - protein, 468 aa, Equine herpesvirus 1
MWLPNLVRFVAVAYLICAGAILTYASGASASSSQSTPATPTHTTPNLTTAHGAGSDNTTNANGTESTHSHETTITCTKSLISVPYYKSVDMNCTTSVGVNYSEYRLEIYLNQRTPFSGTPPGDEENYINHNATKDQTLLLFSTAERKKSRRGGQLGVIPDRLPKRQLFNLPLHTEGGTKFPLTIKSVDWRTAGIYVWSLYAKNGTLVNSTSVTVSTYNAPLLDLSVHPSLKGENYRATCVVASYFPHSSVKLRWYKNAREVDFTKYVTNASSVWVDGLITRISTVSIPVDPEEEYTPSLRCSIDWYRDEVSFARIAKAGTPSVFVAPTVSVSVEDGDAVCTAKCVPSTGVFVSWSVNDHLPGVPSQDMTTGVCPSHSGLVNMQSRRPLSEENGEREYSCIIEGYPDGLPMFSDTVVYDASPIVEDRPVLTSIIAVTCGAAALALVVLITAVCFYCSKPSQAPYKKSDF

SEQ ID NO: 174 - protein, 401 aa, Equine herpesvirus 1
MMYQPDREPGEDSCLVLSSSSVQRCTGSQRGCMPCTWAASKAFVGIGLQACVLTSSILHIDLLTRNSTCLILMIISMYVLSLIRVPISKMETIVTVCRSIQALATLVAASVWVAGSAVKKEHLLIVVTVCILFVFIAGTQISLFYVICSANGTGTHFRASLLAIIGGCVLGVSVKLVELKDVPIGIGIAIAIIASCQDFGLALRDTCHYRIGRYACMRTFTDLGRGINYRWVTDVEAVPKIEEVAEEKVSLFKFFKEMPGVIFSPAVGTHATPIIWIVLRLVYGISNVWQTPAYVVFCLTVGHVSAMLLEQLVIRVNYTAEASSGIHSTAHAVCMVLAAFGYGVAAPLSLAFTVSGGILGALYLRKRATGARRLAATHISRWLIVCVYVAAGLCYATIITH

SEQ ID NO: 175 - protein, 405 aa, Equine herpesvirus 1
MALPRAMRPGGSHPNNFLFNTLPVIDNPVERQRAMAVFERESLRDAFEMLTPIAPSLKNAFLIFNEDGLLIHTSVGGEQVYIPIQTNNMESYSWKKAPPAVFLANVDGRRGLLDAFKAKTQTNVSKVVFEIENYSPSRILTQTVFSARDQTEEDTEMGSDAEGATQTVSSRLVKHEFNNYALMLPTRQPDVSMSLSKAQLNKILGVCKQAGDPITFQCLFDDTLQVRSGDRQVVFSVDYQHADNCGVESSSSLLEKMPMKTKKSAPEPIRGISGRRLFTLVLDEDTNFKQLIQKLKLKNAGAVLNFFLDPDSIPMIGLSTKQPFSVMMFFMCSYPTQPCQVGFSPAAFSSTPMGAGVKRRASEEEESDQPPKKLFPDGKLFKSNFVLLMDKTGAKIPCPEQPMHF

SEQ ID NO: 176 - protein, 497 aa, Equine herpesvirus 1
MGLFGLLKYAYSNRLVKHDAITTPPGIMTPIAIDLWNVMYTLMEKFDQERNFPLDGAAVTARCFFSLLRLLLKRSYYPIFVSDRGIYGDGRVKQGAKAIVSQTMSSYGGSGRLSSACFTGDEHDTEFQEDPEENDVSVPPQDTCPPTEISAGYVEPERKCEHSSTRWSALDGAPRLSYRLCVNLIRHLGYPYVNACNLEADDVCANLYHTNTVAQIYTTDTDLILMGCDIILDIMPLFPPTLRCCDVLMDLGVTYDEFLTEFVRCHTDLHEPQTLASVQSVISSLHSPPDEDEGADMPQTPSGHSWRCPNERRVISWRRQDDHDYDSSTEDSDQSDSSEEEEECPAGKGFGYRENPAVETCKRRTRPRRSAEASGRILHLKYTSRYPPIMESAPRALVRMAPPKTRHEVLERKFVKHVVSMLTPERRGSLSIMRRLPITQEPSNFSLVHDTLKNLVSEHEIARELANMFWNHIPTPTDYNTVLVNYWDDCGHRRQWS

SEQ ID NO: 177 - protein, 321 aa, Equine herpesvirus 1
MSIENSKEAALTAELSLAGAFFYTPECPDIEHLRSLSVANRWLDTDLPISDDLKDVAKLTPAEREFYRFLFAFLSAADDLVNLNLGDLSALFTQKDILHYYIEQESIEVTHSRVYSAIQLMLFGNDAAARARYVASIIGDAAIGRKVAWLQAKVRECGSVAEKYILMILIEGLFFASSFASIAYLRTHNLFVVTCQSNDLISRDEAIHTRASCCIYNNYLGGFEKPEPKRIYELFSEAVNIECEFLLSHAPQYSHLLDIGAIISYVRYSADRLLGEIGLSPLFNAPKPSPSFPLAFMTVEKHTNFFERRSTAYSGTLINDL

SEQ ID NO: 178 - protein, 790 aa, Equine herpesvirus 1
MALNFLQSDCPLAIIQDVISRVDAISDYGYANELSTTLPPRPSRSQVLEYITRVVDTLKPRCRVDERLYVVCGELVHLRIRTRNVEDLKYWLNSTEIALNEIVEKDILDHLDFIQRTLHAFESSEYRELCALGLQSALKYEEMYLAKMRGGRIESMGQFFLRLATTATHYTMEEPAMARVLVSGEVGWTYIFKAYFTALAGQVLIPATPIMLFGGRDCGSLASCYLLNPRVTDMNSAMLALMEEAGPILCNRGGIGLSLQRFNTPPKEGCSRGVMALLKLIDSMTMAINSDGERPTGVCVYFEPWHADIRAILNMRGMLARDETVRCDNIFACMWTPDLFFDRYQRYLDGESGVMWTLFDDTASHLCHMYGKEFEEEYERLEQCGFGVDSIPIQDMAFIIVRSAVMTGSPFLMFKDACNKHYHFDLRRKGAIMGSNLCTEIIQHADETQNGVCNLASINLPKCLAIPPPHTAGVPYFDFAALGRAAATATIFVNSMMRAGTYPTVKSQRGVDENRSLGLGIQGLHTAFLMLDLDMASPEARQLNKQIAERLLLNSMKASATLCRLGMKPFKGFEDSKYSLGELPFDSYPGVTLANRNAWRRLRTEIKQHGLYNSQFVAYMPTVSSSQVTESSEGFSPVYTNLFSKVTATGEVLRPNLLLMRTIRSIFPRECARLQALSTLEMAQWSVVGAFGDLPVGHPLSKFKTAFEYDQRTLIDMCADRAPFVDQSQSMSLFITEPADGKLPASKIMSLLVHAYKRGLKTGMYYCKIKKATNNGVFVGGDLVCTSCSL

SEQ ID NO: 179 - protein, 465 aa, Equine herpesvirus 1
MNLGGNRFVQIGNGMSNIMYTDANGAVRWEQISPPAGFPQQQRGRGRGHVAFGLPNTLDWLPGFVQATPNSITISNMGGIQISSAGVITAAINSEQNSWMLSSFNPSLKLTRQVTLTDFCDPTAERPGLPIIRLRHHLDAIGSSPSSTPPGRNPQELDEAWAALSELSVSGRSDTTGLRPSLLSLTFLVASRSGEYSDKAAAEAVRAHVLANYRDRRTEQRLDRFGEYLQAMVRTHVFPHKHMTVFGGLISHVIQDKLASLTAVAGGVQEGARTNNSAVPRSSVYVPACAFLDVDHELKLGDASAKFVYLIFVYSQRLRREGVRVYVAVSKFDEVAFEDAVSFLFHKARTESAIRGTEGADAPEPHPNAALPLQELSSSRCEPRCPPSRLNNREFTNALYQWAPDLRGRPNRTSCMYAAYIRLGAIASDSPRTTRRSERFGSVDMPVVWLENVRWDPQDWVECSY

SEQ ID NO: 180 - protein, 1020 aa, Equine herpesvirus 1
MAREHGSMRALVNSLAGLLGETDTEVPSLEPAMLMVLKSSISEFFLSTDTVSVDEAAELFPRLQFLACRAYAASHTPDAAMLAENLAGLVLWRIHQNWTDREMEAVDQMFVLLEIMNGESGVYMLSNNNLRISAKYGPSNMHLIVSTWLDTFRNVMSVAAKSTPDSLFNSKRMESIEEFSKPLVHAKFNLIYDMPFVQEGLRIVAKKINWILPFGLMVKGYKDMSMAPLTRALFLLSLVDSYFPKGTATEGSMKALTAYFRELVRTIDNSAFVPITEVNATPRTAYEVRVSSAIVHQNPYVTDTKAGMVAERVRTDAEILTSGALLSSGALSAHATAVAKLLSSNEPDDVSSRARARVAEHASNTWETIQASTTPTQVVEALVTAGFTSTHCGILERVVVDYFTRLRSTANSGPGRNDSLDYAQQVVGCVAIVGGVVFRLLLSYGFGLDYIRDYTTTISTLEPVYNELLSALGLADKGVEQTLKRSMAPRPYMNYISAARAALDDELLIVEKRTTGPGTHSAARESLLTWFDFRARDRWGVRIPDRDTTSTQVLAPITASLYSDDDLIAAASKLSFDALDAPPTQIIDDPSFAPYMLATVVLDAFNAILTSRFSADSVSQALRVLSWARDYGAGSIANVDGYRTKLTAIIASVSPFLQKDAPTPTMAHANNLEALLGELHSVVVAAIALIPERARMPVPERPSVKTSTFLAGLFLTAVYKRLETLVGHTAELTNNILGTASGIVSSIVTLNRFFNCRIMPVMGHYAVLIYPQSAQSAPFGRWRLVDVVDAVGSIYNEVSDLRADLRADVVTLKGDITSAAEALQECEALAVKTEGTRFGKLFNSLLTRHTQLARAQRGLAIRAGKLLGGSEAPGLKHVNTFLQRWGAISVMYQKATSGSTPEVNITSLANTLRHVWDEVQQERKATPPSRKFSNRDLGLAVERLMGGYPEVLDDDSNSTALTPKFNVDSWNSVNMDALRKRVTMPANIDSIRGNDSLATREYLKKEDLLAEIDAIFNNTK

SEQ ID NO: 181 - protein, 3421 aa, Equine herpesvirus 1
MAQTLVPANKAGGAQADVVVIGYRNQYDSQLGEGSHVSCLRSSLSFLRLIFTHGIDFALTADSIDGVLVEGRAWTVAGSKSGEAPCMVSIVELPNKITYANSANALCCVFSRLYGDSGFYMHPGDGFQSTQIPARQFFDGVWKSRSESFALITIGAIGLAVYRHGDVAYVFDPHGHGSVTEAFVVRVLARDVYAYLTGYAATDPESDWAGALVFFVTCGPTESEPGFLISATSLLYGISETYLSDEQYVERSVATSHPGISTPPPLTDVAVGAVSEAWQYQELENGAATLDADMEGVAPAAAQVRASVIRQPTEKRVSLPKRRRPPWTPPTSSENLTTSGNTHTVAGRPSQKVRNATANVQNPTTGNGSAWAEALNDGGVDNASRPGQAVGAAGTLQNPAPGDALAMETTQASEEALRTRRVFRLSGEDEAPYDLGDAVGVLSAEINELATRAEELDVLSSTCVDSTVWVTRPHNSPDMDILEQFITMIFNRLLSFLVENGARTRTDSPSVIAGLFPGVLAAIPTQSAVVNLLQATGMALSDVASYKSILNMVSNEDSPVGELAVIKLELVASEVIKSTQKLVARVEELERDVTSGSVNPLGLYTYLTERLVAEMTKHGGDLFAREPKPGAVSLTERIGSLFRKARTREARATRTNASLARDLNAIEAAVHAAHDKFDAIEIKPADPSDTTNMDELAKSLDLSAVPTRVAKVIKKVESMVSDSIREYFLRGVQYSARAIAMDKTSGARFQVASAAVSNLERMLDSLPNFEKSLNSVVASAGIQGPPPAQISGSRKATLLGNLLRAGQNLTTDNALGAWAALLSEAHTEGHIERRELEAVIKEITSINDHAAKKASVEADMERFRVLSAAVDQATSDMYNSNPHALDTIIRGAEEMIRQAKVVEAHFDSGRISREAASRVGVRKREVETLANSARQRAAEISAARDEIYSRLQSLLLPLAGFVGLRAAPGVLEQLAKDAQRSTSEELRNLMHEAPKQVVSTVHSHLWSLFGQFREALEHPNSTTSSALAGVGPAFAIVVRSLLDPNKQRESVEFFITHADALADTVGAVEANPNSELAVAHAVNSIAAAIQTVSVGGRTITEFAFLVPMLERYQSRLTIVRETQRLATAQRAVAASVSAAAEVTTKLRAVAVPGVQEDVLKAAIAAAKHVSSEVTAAATAAERELARLDSKALSVAQVARAHQDLQKQTAVAKQRVGEIEEVLANLNKQQRELQDRAVHDRWKSDLLAALDKIETKSSFDVSELSRLRDLGAARGYDSREFAKRAEQALAANARAVIAVLDNVFKFNPYAPVNSKKETNPTISMLYNISWWDDFTLAAPILNTLFAGVDVEELMSLMRISTGMITFASTNGGRPKYNEAVNSLSSDMLKVPQLAKYVDFYGKWYTEFNAEMDVLSKLRADVLQAVGVRSGEISRALEEVTYVRNAEVAEKVLADGVKLYIPSDALIAKAVKYLEEFNQKRFAGSAFEEAIATTIRQDLSTAREAATQAEAARSEAMHRATHILREVVEAAKAADRDASANLANLKNLLRLTPPPQSVAAALDKATSSDDIVTQAALLLGTVESTPELDIKAVEWLQQARSIIDSHPLTTKIDGKGPMDPYAERIEKLHTLRGELDELRRQLTATEVSWDEAWGNFSRAVPRADVSMDGFVDAHQRARTLQASMGVISEMRADNKYGRLPPKVIGAIESKFAERHKNLETFNDTSTVLQTAITQFDSLVQQIPPEMEYDVLRSLLASFDQLAAVLPKWVGAEYAAYRSLLLMRIGLYDEYQKIAGIAAAGSRPHLEAVEYRSAVEDANLRRASRVSSLMGDKDVILSLREAKSSIDTAFPQVLLDAKGVPVEYRVCYRAVGDKLAAMLCGKLGVSMRPAMPSDPIVESSSVSGINVTHDILQLRFGLEKAYHSGFSTFARFVRHKRADWSPTEPAQAAAEIYAAVLATTLTREYGATWHRIRFMASSGLFVASPDSVCDTQGGRGKKSNNIVHLTLSDVVLSAMLRNSMHLVNFMRLDLTRQHEYMARTITPVLTKSLLSDILINTLVPTDTSTQWRSLPLAGDLEDLAQGMLFSIRMSDWKQNSFSTTSLLDVWMRSPGESGRAAAAKIASAIPGNPLATFTVLARMCIPPNALASLWEALQPEAFSQQNLSYDDVVTSRLDIASTVQTSVAVDPEMKSVDTKSRKQLYTTTGTSTTFTLAGSAPSAVKEVSALDVATCALMFGAPVVIAMETPEMFSEASGMSFCLKIFDSRPGATDHEIIQAVSSDLSSWGTSLLALDPNAIENACLTTQLEILSGLVASKLLAPAPPCLIVLDPSMRVIKVLWESESPPNDLVITLAEDEIIAELPYLNADDDLLPPMNPDDPIYTRVISGTNIPTATTEGSLFADQQLEFLRPESNPFPFASHDSSQSLDVPSSPSSGSDKYEEDPTGIVYDAPVDDMSDMAMNKAKAWQEWLEDGFAEDDYRELSNAMPAPPKTTPVVESKQKSDSVDRAPTLPPKAAPLPPSDASAIMSGKPVFKYTPGNKSAVPPSVPAPPTLPPAPPLPQSTSKAASGPPPTLPPAPPLPQSTSKAASGPPPTLPPAPPLPQSTSKAASGPPPTLPPAPPLPQSTSKAASGATQSDSGKTLTLDVPKTQSKDKVVPVPPTDKPSTTTPAALKQSDASKPPTAAIQHQQKLGTPVTPKDSGDKPTDNASAPVGVSPVTPDGTPGAKPPPKDAPPVDDTKQPVRKSLPSQVRGGRPYIRPSLGPFKFTGPPGYTIPVHGLPPSDSNVTQSTKEPPKPAVETPAAAPAKSAAAPAAAPAKSAAAPAAAPAKSAAAPAAAPAKSAAAPAAAPAKSAAAPAAAPAKDQTKSAAEVPKPAKDQAKDQAKDQAKDQAKDQAKDQAKSTTGQKLAKDPKSDGLTDDVALEIVPEKTPLPDDSPIGAVPENTPLPDDSPIGSPDLSASKNSHTTDAVSSDRFSVACKVPLPDSPEDDFYSYAVDVPLPDSPTDDPSSGRSDARAPTVGGVASIHRKSDSRNNRQSDAWRRAFADTLHGRPRNRSATKPCKSAPYKVPHAISYTKIPSVPNDQSGLAGKPCSEEPKRPTGRDTPVGSWNVSPSQAPADIPTAIPQNQNTSESPRTTSLKSPTRTVQSSMPADDIDELAEYDLQIARAVPVTKHPQPPPANQTPPPQEPPAPIDDRKNIRPPLSEEEIIAFLINMDDDDAGNASGPVDLHSVQAPKLPKQSKPTTNQFVPLDWWTETEPVVDADSLDLSPKQQRLFSWESTRDLLNINVRDRVYEEESDDEYTVSWDQHLVPAVSPTSVSSYSSDTVTDSYTDINDPRSVVCPLDGNAQNNVREFLDTHSSRVRVVPADELLSRRYFRSTSLSAMALLIAACRTIVRRLRATRRVLTDINRSLLLDLKQIRVLLG

SEQ ID NO: 182 - protein, 119 aa, Equine herpesvirus 1
MAADKQQQQAPVAFNPADPPNIKAANFKDMLPVDVITILNQNIDELDYTKYTEDEISEGLKQLFMGTARTMVSLRQRHLKSLVRRSDMFAQNDASTWARPNIGLKRTFPPRFMQPISED

SEQ ID NO: 183 - protein, 275 aa, Equine herpesvirus 1
MDSYNYRDFAVGGGLLQRIRLVVSGSLHCGESDATLNDPKHLPARCVFQFSGPDNNSVTFPIEYVLRLMKNWARSQCDPYIRIQNTGVSVLFQGFFFAPPNAPMASITSEHNNVILKSTHTTGLALSGIERVKRGGGLDLRPLQAMMQISCFTRMPVVQLSFRFMGPEDASRTQRLLERATSFGAMELHQKRTVDSCDRSNGIVSPREHRECRERQKRRPTPKRCASEVFASLASISSAFASERVKRRPVRIAAAILAFVFVAVILAIATKGRLF

SEQ ID NO: 184 - protein, 162 aa, Equine herpesvirus 1
MYGRSNAPGCQPPVRAHPPSSPMTSRLQLAAMEQNASDAALSGMQQARSRQASPKRLRDLIPSSDVESMSLNALDDAYGHHDFSVWFEDLMPPEMELLMPTTDAKLNYLSFTRRLASSVFHSPDNRMPGGACDHTSALDARKERFATIINKFLDLHQILHDA

SEQ ID NO: 185 - protein, 620 aa, Equine herpesvirus 1
MAASCNLDVIGEDGGCALTGGWQPGAFERPYMGFDARLLSTNSSLCSELIFSAHLMQISPTPQPREQVDVCEDPDNDPPEPSCAQFVDAVADSLALDKLCLICRTIDLYRRQFGLSPQWIADYAMLCTKTLAAPPCAVATVVAAFEFVYLMDKHYLRRGKTTLVGAFARRVLTLVDIQRHFFLHVCFRTDGGVPRCAASGTAPAATAMAGLGMADKVQYSNYSFLVQSSTRAMLLTVADVPSGDDGALQAVPHGRHGAGRPADGGGGVFGPKQQSTVAALMSWKECAKMIDCSGSERRRPGATMTCCERARADDDEYERQLLSTENTYLGSADNQAEGGNDTHLKWGYADLTLLLLSQSSTWEASEKTSLASQSRRACVEEYWASHRTVLARDTAPRFARFVDADAVPDTATGPVLATTLKHVRSRGRTCAECVLCNLILTREHWLALRRFKRDVISYSSNNANLFDCISPVLSALSDANSEPLAGDCGVGGGGTCPEDSGRFLELMHAAGTEAIYKHLFCDPMCALVELQTNPSVLFSPIGPPPEPDEIELQKARLASENWFSGRVCAGLWALAFTFKTYQIFTPKPTACAAFIKDAGLLLRRHNLPLISLEHTLCNYV

SEQ ID NO: 186 - protein, 326 aa, Equine herpesvirus 1
MFDGRSDIYDSTSFAAELDDLYSCRSTGRENGRRSRVSTRGVHRDRCGSAAKRRSTKRRCELVARERDRYSLYLDYMASHPSDEISAVRELVVPLIKTTSITLPFDLNQTVADNCLSLSGMGYYLGIGGCCPTCTVSGEPRLHRADRAALILAYVQQLNNIYEYRGFLASVLAAAAQGDQAGVAASEGVQAERLLENVLAQPELFFAYHVLRDGGIQNVRVLFYRDLSVSGYMMYAVFPTKSVHLHYRLIDRLLAACPGYKIIAHVWQTAFVLVVRRDEGQQTDMDIPTVSAGDIYCKMCDLSFDGELLLEYKKLYAVFDDFLPPV

SEQ ID NO: 187 - protein, 1220 aa, Equine herpesvirus 1
MAAREQANSVRRSGFFNPFIGKRPFFRPGSGQTAETERPRPPQHSYCTEVGSFKFIAPRCLDEEAPADQRRGVHVGTLERPPKVYCDGSEYDVLNFASGGCWPRRIRVWNGQDFRGDGFNPRFERFHVYDIVETSESASHDDPSRFAELSRPSGSVVTLLGMSECGKRVAVHVYGVRHYFYMAKAEVDSACGITTEAELVRAMVDCAHSSALSAALGNGNGGKQSGGSGGGWWGGKHVSADCFKVETVCHTTLYYFGSKPALYYRVSASSSRLGGFICDNFHPEITKFEGSVDVTTRLLLDNENFTSFGWYRLRPGTHGERVQLRPVERHVTSSDVEINCTPDNLEPIPDEAAWPDYKLMCFDIECKAGTGNEMAFPVATNQEDLVIQISCLLYSLATQNHEHTLLFSLGSCDISEEYSFACVQRGEPRPTVLEFDSEYELLVAFLTFLKQYSPEFATGYNIVNFDWAYIVNKVTSVYNIKLDGYGKFNKGGLFKVWDIATNHFQKKSKVKINGLISLDMYSVATEKLKLPSYKLDAVVGDVLGEHKIDLPYKEIPSYYAGGPDRRGVIGEYCIQDSRLVGKLFFKYLPHLELSAVAKLARITLTRVIFDGQQIRVYTCLLKLARERNFILPDNRRRFDSQADAASETSELAMDSQSHAFDSTDEPDGVDGTPDAAGSGATSENGGGKPGVGRAVGYQGAKVLDPVSGFHVDPVVVFDFASLYPSIIQAHNLCFTTLALDEVDLAGLQPSVDYSTFEVGDQKLFFVHAHIRESLLGILLRDWLAMRKAVRARIPTSTPEEAVLLDKQQSAIKVICNSVYGFTGVANGLLPCLRIAATVTTIGRDMLLKTRDYVHSRWATRELLEDNFPGAIGFRNHKPYSVRVIYGDTDSVFIKFVGLTYEGVSELGDAMSRQISADLFRAPIKLECEKTFQRLLLITKKKYIGVINGGKMLMKGVDLVRKNNCSFINLYARHLVDLLLYDEDVATAAAEVTDVPPAEWVGRPLPSGFDKFGRVLVEAYNRITAPNLDVREFVMTAELSRSPESYTNKRLPHLTVYFKLAMRNEELPSVKERIPYVIVAQTEAAEREAGVVNSMRGTAQNPVVTKTARPQPKRKLLVSDLAEDPTYVSENDVPLNTDYYFSHLLGTISVTFKALFGNDVRTTENLLKRFIPETPHKTPTKTQALLERAGFEKLTPFTPEEESRRILHTVFCTLEAAPHQS

SEQ ID NO: 188 - protein, 1209 aa, Equine herpesvirus 1
MESAPKTVSLPVSPLGYVYARQKASLQTGTVSLTAARSVDSDLAVLPVIRGLTVEQTFTTNVAVVAGSKTTGLGGTGITLKLTPSHFNPNAFVFYGGSVIGASSNAPNLTRACEAARRRFGFSAFSSPPVENAVETSGEEICASLNLSPETTALYLVVTESFKEMVYVCNTFLHYGGTSTVTIDGQDAMKIPIYPVQLYMPDVNRLASEPFNAKHRSIGDEFVYSRPFFNSDLCRLLHGYVLGPAAVALRVRNLDGVARGAAHLALDENHEGSVLPQDVTFTLFDSTQGNAGKGSGRAQRQGDGSGSKNSASSGIERRLASVMAADTALSVDSIMGAGIYDTELPSVEDWPVLSSGDDTESLEALGAYAARLSGLVGAMVFSANSVLYMTEVDDGGPADGKDGSNPSYHRFYLIAAPYVAGNPQTDKDGRVLPHTADQQAAPINGSNQEFSLDYLALACGFCPQILARLLFYLERCDAGTFGGRNETDALRYLANTLESDVPCGLCNQATRPACAHTTLHRLRQRLPRFGAPVRAPIGIFGTMNSAYSDCDVLGNYASYGALKRPNDNEAPKSIMQDTYRATMERLVNELEQAKLIDKETLAQASPCSAPTSVVHDQASFIGLLSNIKDTIEGAAEQFMRTLVEARDFKIREGLADANHTMSISLDPYSSSFCPVTSFLARRTVFAVLQDLVLSQCHCLFYGQSVEGRNFRNQFQPVLRRRFLDMLNGGFITAKTVTVTVSDSGVLAPDLTRPASEPPTKDYDGDMARVSMEVLRDLRVKNRVLFSNGGANMSEAARARVAGMASAYRRPDKGSNILNGAVGFLVKQYHGVLFPRGHPPGIDTPNPQWFWTLLQRNQMPARLLSKEDIETITAIKRFSDEYSAINFINLTPNNIGELAQFYFANLVLKYCDHSQYFINGLTAIVVGSRRPRDPAAVLAWIDRTINGAADVEPAAQEVLQRLGSNPAAWTGTFTSTNMVRYVMDQRPMVVIGLSISKYNGSAGNNRVFQAGNWNGLNGGKNVCPLMAFDRTRRFVLACPRVGFTCEAGGFGTGVRENTLSEQVRGIVSEGGPMVQTAVFAAVLHALGARTQHLAVDDWIGLVDDEFLAASLDALNATVVDQFGEWSVEAAQELVKNMEAQTTAGAVAAGEGAFDFGACVGDTPQQSTSAFNGGLAMAAAPAGQKRSLPDDILFDMGAPPEKKSGLTFDML

SEQ ID NO: 189 - protein, 775 aa, Equine herpesvirus 1
MEQDDAPAAMGSAQARQRLLAIFGQVQAYIFQVEMLKRCDPSALLPLVGSLKLNALTIRMLRRKLGGALIEQAQHQQTPLACALTMALEYAEVEGERVLRAVDDVNLAGPEGFFRATMRLDEPCEYHVRVHLDTYGGPIDAEVQFLHDAENFLKQLNYCHLITGFEAGLDALESVARFLTRTVGSGIVVPPELCDPTHPCSVCFEELCVTANQGEAVHRRLLECTCDHITRQMAVRVANIDIARHLPHALSVASERRAAAEAALRALEARRVQGHNGKSAGTEDPTQQVASRLLESHHVFKPASRCLYAVSELKFWLASTKHGDMGQPRAIDTFTENLETLDKQEKFFHLQAATVELALFGRTLDHFDRLFADQLLGLDVIDGMLVGSCAVSPDDHIEALIKACYTHHMSAPLLQRLTDPDTSNREALKQLLGRIGVDTDDGAGELGDALDVDLDNLGGAPPVNSTPCGEDALCRTVSEERPWDKLLERATADASQRRRMYAERLSKRSIASLGRCVREQRRELEKTLRVNVYGEVLLHTYVSSYNGFCARRGFCAAVSRAGTIIDNRSSTSAFDSHQFMKAALLRHPIDQSLMPSITHKFFELINGPVFDNAGHNFAQPPNTALYYSVENVGLLPHLKEELARFMITAAKGDWSISEFQRFYCFEGVTGVTATQRLAWKYIGELILAAAVFSSVFHCGEVRLLRADRTYPDSSGAQRCVSGIYITYEASCPLVAVLSAAPHGAIGAETVVIYDSDVFSLLYAVLQQLAPGSGAN

SEQ ID NO: 190 - protein, 980 aa, Equine herpesvirus 1
MSSGCRSVGGSTWGNWRGDGGDLRQRRVLSPVCSAPAAGSWIGSQLGNVGNLLATPHPLGKPASSRVGTIVLACLLLFGSCVVRAVPTTPSPPTSTPTSMSTHSHGTVDPTLLPTETPDPLRLAVRESGILAEDGDFYTCPPPTGSTVVRIEPPRTCPKFDLGRNFTEGIAVIFKENIAPYKFRANVYYKDIVVTRVWKGYSHTSLSDRYNDRVPVSVEEIFGLIDSKGKCSSKAEYLRDNIMHHAYHDDEDEVELDLVPSKFATPGARAWQTTNDTTSYVGWMPWRHYTSTSVNCIVEEVEARSVYPYDSFALSTGDIVYASPFYGLRAAARIEHNSYAQERFRQVEGYRPRDLDSKLQAEEPVTKNFITTPHVTVSWNWTEKKVEACTLTKWKEVDELVRDEFRGSYRFTIRSISSTFISNTTQFKLESAPLTECVSKEAKEAIDSIYKKQYESTHVFSGDVEYYLARGGFLIAFRPMLSNELARLYLNELVRSNRTYDLKNLLNPNANNNNNTTRRRRSLLSVPEPQPTQDGVHREQILHRLHKRAVEATAGTDSSNVTAKQLELIKTTSSIEFAMLQFAYDHIQSHVNEMLSRIATAWCTLQNKERTLWNEMVKINPSAIVSATLDERVAARVLGDVIAITHCAKIEGNVYLQNSMRSMDSNTCYSRPPVTFTITKNANNRGSIEGQLGEENEIFTERKLIEPCALNQKRYFKFGKEYVYYENYTFVRKVPPTEIEVISTYVELNLTLLEDREFLPLEVYTRAELEDTGLLDYSEIQRRNQLHALRFYDIDSVVNVDNTAVIMQGIASFFKGLGKVGEAVGTLVLGAAGAVVSTVSGIASFLNNPFGGLAIGLLVIAGLVAAFFAYRYVMQIRSNPMKALYPITTKALKNKAKTSYGQNEEDDGSDFDEAKLEEAREMIKYMSMVSALEKQEKKAIKKNSGVGLIASNVSKLALRRRGPKYTRLQQNDTMENEKMV

SEQ ID NO: 191 - protein, 160 aa, Equine herpesvirus 1
MDSPRGISTATGDAHAEAAVSPAAEIQIKTEAPDVDGPEATTECLDHTYTQQTSGGDGLDAIDTDDLLEMVLTSENTESEPGIPFALRGNFICCRDDNCRACRELPFRPSVIGFSRDPHVSMALDMTSGNWAYVPRVFPDTPTAPWMANYCIPDLDEHAD

SEQ ID NO: 192 - protein, 646 aa, Equine herpesvirus 1
MDAYTVDGNAVSLPIYVAGYIALYDMGDGGELTLTRETVAAALPPASRLPINIDHRNGCVVGEVLSIVDDARGPFFLGIINCPQLGAVLATAAGPDFFGELSEGLSEQERLLYLVSNYLPSASLSSRRLGPDEEPDETLFAHVSLCVIGRRVGTIVTYDATPENAVAPFKRLSPSSREELLITAREAQSRLGDAATWHLSEDTLTRVLLSTAVNNMLLRNRWNLVARRRREAGIEGHTYLQASASFGITNGCNKADFCGAELVDTCGYKSGEKVHGAPYSRVTLGAKAFTSSSPNALPSSDNDKGGIGERTQKHISAMASSNPQTLSAAGAPLVSGDYILVPAAQYNQLVVGQHTSHPPINAGPAPVTHAVPSQYIPPAYNSLMPPSMYQAPPYWSVPHSANLEAQITALVGALAADRKATKGSDPHVIQGSQCSPPLSPQQERRYARKRRHDWDATTRDDLEGIYYPGERSPRPGERRAGRPSTTIADLMGAVSSLQQEVSQLRAIQTVTAQPQAAPAGLYKPIPAVPPQYSQYQYIQPQHAVSAIVAPQLPGIPSQPTQAVLAPQVPAGEAPGSAKVVAASTAPQQAEQARAAPQQFEAVTSAAVLPVTQPQASSQTVDASASTGLEFGRDDADIFVSQMMSAR

SEQ ID NO: 193 - protein, 329 aa, Equine herpesvirus 1
MASSNPQTLSAAGAPLVSGDYILVPAAQYNQLVVGQHTSHPPINAGPAPVTHAVPSQYIPPAYNSLMPPSMYQAPPYWSVPHSANLEAQITALVGALAADRKATKGSDPHVIQGSQCSPPLSPQQERRYARKRRHDWDATTRDDLEGIYYPGERSPRPGERRAGRPSTTIADLMGAVSSLQQEVSQLRAIQTVTAQPQAAPAGLYKPIPAVPPQYSQYQYIQPQHAVSAIVAPQLPGIPSQPTQAVLAPQVPAGEAPGSAKVVAASTAPQQAEQARAAPQQFEAVTSAAVLPVTQPQASSQTVDASASTGLEFGRDDADIFVSQMMSAR

SEQ ID NO: 194 - protein, 587 aa, Equine herpesvirus 1
MAEYVNYVLGSLYVSDTATSTIPTDVRNFIAPPFPLNFWSGPTFTVSSNTRADPLKLVAARHRAAAAAIDTLEAQSQYGVANVDALIRPLERQVAKVADALAALEDAARAAESADAATPQVNASEADQRPDNIGQSLSEIQIAKNDVPMEFDTNLAVDLLATVFVSRAAGGSNGVVFGTWYRALQDRLVTERPVATRSIDYRDGRMSKTFMTTAVVSLQSCGRLYIGNRPYSAFEAAVLCLHLAHRAVNSNYTYPTSFSGLIEQLPVYIEAFSTALGDGTLGKVGYEFNGARLPKNQFHVPGGGGRYERGALNGHGVLETLIRLKVLPAIPGSLGTTSTAVGPELDADQTAYIDDVNKAAAAFLVRAQNLFLTEDQTLLRSTINTITALLLLRRLLWNGNVYTDRLRNNFQLGAIVPNLAVSQRDARGASGGDAAAMVSRSGNNNFTFLCERYVSPIYIANREVELTQLFPGLAALCLDAQTVARDQPQHRAVNVSTGRNQTNLTRLIGIELENRRRTAPVPINEVLAAHDAVALQYERGLGLLMQKPRLRASLEETRRLGQFNVASDYDLLYFVCLGYIPSLTSAM

SEQ ID NO: 195 - protein, 272 aa, Equine herpesvirus 1
MKRRQRLTARSRLRAGIRCHNRFYNAMVQDLASAKRNGVYGERLAPLFSELVPAETLKTALGVSLAFEVNLGQRRPDCVCTVQFGKGSDAKGVCILIELKTCRFSKNMNTASKNLQRKGGMRQLHDSCRLLARTLPPGSGEIVLAPVLVFVAQRGMRVLRVTRLSPQVVYSNAAVLSCTISRLAEYAPPVSAKSTRRRCVAKGTKAKAFSTKAAAEPVPSITPAQPSAAAAVVSLFPAAVPANTTNAAAVHQPVAVSHVNPLAWAASLFSPK

SEQ ID NO: 196 - protein, 352 aa, Equine herpesvirus 1
MAARVPSGEARRSASGAPVRRQVTIVRIYLDGVYGIGKSTTGRVMASAASGGSPTLYFPEPMAYWRTLFEADVISGIYDTQNRKQQGDLAADDAASITAHYQSRFTTPYLILHDHTFGLFGGDSLQRGTRPDLTVVFDRHPVASAVCFPAARYLIGDMSMCALIAMVATLPREPQGGNIVVTTLNVDEHVRRLRTRARIGEQIDMKLIATLRNVYSMLANTSNFLRSGRVWRDGWGELPLSCETYKHRATQMDAFQERESPELSDTLFAMFKTPELLDDRGVILEVHAWALDALMLKLRNLSVFCADLSGTPRQCAATVESLIPLMSSTLSDSESASSLERAARTFNAEMGV

SEQ ID NO: 197 - protein, 848 aa, Equine herpesvirus 1
MLQPYRKMLIFAVVTVAFAMAVWSTPVPATPSGVGNATWANNSFNITRYDKITMGQVYSNTSNSPIFFVVISERNFRIVNTPLGASVFWIPKGAMNPPQHQPCVANGPEPGDPRGPCVNSTVSLLFNENVEPFLMSKNLLEFEVLPDTYITGWTFERSKTATTKSNPVGVVLSPPRGSPSANTTIRDDGGPKKPLSIIDEYTTLVADLQNFTMTLTYISPFAAVWPIEAFQTGITVMGCDTTQVVAYLGHGFMGLQISSVNNPPLEMIVVPNDVSARILNRRPSRLRLEPPGPHAGPIYKVYVLSDGNFYLGHGMSRISREVAAYPEESLDYRYHLSLANLDTLAMLAELSSGKSTDVSYYMYRIVARLAVATFSLAEVIRLSDYMLLQEAIDVDMNLRLIVPLVMKYAAGGAADSSYTSSDVAMDQFDVAQSQIEKIVSDINVEAELRKPMYEHRSLLRSVYAYSRKPLPNAVALADRLILAMYKEAIKDRITWNSTMREVLFFAVGAAAGSHVILTDEPEPGAPAHKDASLFLSLNRNILLLCTAMCTASHAVSAGLKLEEVMAGLVAGGVQFSLLEVFSPCMASTRFDLAEEEHVLDLLSVIPPRLYTDLNTGFEDDGTTIHSYGRSANGILNSRIAYNFDAVSVFTPELASCSTKLPKVLVVLPIFTNRSYVITRTAPSIGLTYSLDGVNIAKPIVISYITYGNCEVSRATIKSGYLDNPGHTQTCVYCGSVFMRYMVSGAIMDLIYIDDKEVELQLVAGENSTIPAFNPKLYTPSMNALLMFPNGTVTLMSAFASYSSFKVPSTYLWASIGGLLLAILILYIIIKMLCGGVTNDGYKLLLSYE

SEQ ID NO: 198 - protein, 530 aa, Equine herpesvirus 1
MDFKYSDTVIHNGVVFYITDGGHRVYFLYGGCLLSVPRPHATAESGEIAKFGLTLRGLTHNDRVVANYVRSELNRTGRHESAPSSEEDVFVDRLEVLAQGAQAFGRDICGSFDLEVYDPYLAECMVSLKVTSGLIVSTGRDIPQDGMLHLYTVPTITNASSGFIYTPNIACFTLVQAYLTELPPELETLISGLFDRIPVARPPLRDESGGHSRTDIIVTSPRAVKTMAIGGTTRCSKRPLRKTVVSDFVQVRLIPKPCSIWDSASRVASGASLQSLQLLFKIADEIILIEEPWPGLDEHLNQARSTIVDAILAVYGNEGKLRFFGGKLTQQGVTTLQRFVLCQFILGKWNLINCYAALEQLAESYIGAVPEARDPLPDPHLVADAVNEIIRESGILGELCEIIVRYTQPTDPVNGSGSEVVELEARLLAEFAANATRVELGLSSYDEVRNMEARIASVLNKLYAKDGIGGAAQVACRILGSGLPVAIVLNVSSITAFDGLDLSRKGAYYLYYLLSERLKRGGVTVHVSRK

SEQ ID NO: 199 - protein, 239 aa, Equine herpesvirus 1
MPQVLMGNTRLHAPLEDGIPLIENDENSSQNEVDLYDYVSMSSYGGDNDFLISSAGGNITPENRPSFSAHVVLFAISALVIKPVCCFIFLNHYVITGSYDFAVAGGVCTVLYYMRLALTAWFMFRNIQSDMLPLNVWQQFVIGCMALGRTVAFMVVSYTTLFIRSELFFSMLAPNAGREYITPIIAHKLMPLISVRSAVCLVIISTAVYAADAICDTIGFTLPRMWMCILMRSSSVKRS

SEQ ID NO: 200 - protein, 1376 aa, Equine herpesvirus 1
MDRRSEAFKIPVPEVIPAGQILSTIEVSSHRTLFDFFKQIRSDDNGLYAAQFDVLLGTYCNTLTLVRFLELGLSVSCVCTKFPELNYVNDGTIQFEVQQPMIARDGPHPVDQPTHTYMMKHIEQRSLSAAFAIAAEALGLIGGTTLDGTQISSSLRVRAIQQLARNVQTVLDSFERGTADQLLRVLLEKAPPLTLLAPLQIYRDEGRLASRVNRAVLVSELKRRVIEDTFFLTKHERNRKELVVARLAELVNCTAPSVAVTRMTHSDTKGRPVDGVVVTTAGVRQRLLQGILTLEDMAADVPVTYGEMMITGTNLVTALVMGKAVRNLDDVAHHLLGMQRDQVRANEKLIKDYEDVPSTARVRADLVLVGDRLVFLEALEKRVYQATNVPYPLVGNLDLTFIIPLGIFKPATDRYSRHAGSFTPTPGQPDPRTYPPQTVYFFNKDGNLVQLSFDSAAGTVCHSSFLDVDSVLVAIRREPHELHCAFGAYVTLPPAGTLLDQMRRFFERWHMLMPARPRWTAEALMTIDQLLSPGNANLRLELHPAFDFFVAPADVVIPGPFDMPNVMPTVMAMPRLINGNIPLPLCPVEFRDSRGFELSVDRHRLNPATVLAVRGAFRDANYPMVFYILEAVIHGSERTFCALARLIIQCIVSYWRNTHQVAFVNNFYMIMYINAYLGNGELPEECTAIYRDLLEHVQALRRLVAEYTVPGEAVGGQGHDALNNVLLDPALLPPLIWDCDPILHRADMGRARAQELWVDGVDYAAIPWVEMAEVNFGNTGGHLVHNRPIRGENKRNPIVPHHDPEWSVLSKIYYYAVVPAFSRGNCCTMGVRYDRVYPLVQTVVIPDLGAEEIAPTSPSDPRHPLNPRHLVPNTLNILFHNARVAVDTDALLLLQEVVTNMAERTTPVLATAAPDAGTATAVTQEMRTFDGTLHHGILMMAYQRNDETLLEGTFFYPAPVNALFACPEHLGALPGLNAEVLEAARDVPPVPHFFGGNYYATVRQPVAQHAVQSRADENTLTYALMAGYFKLGPIALSHQFATGFHPGFAFTVVRQDRFLTENILFAEKASESYFMGQLQVNRHEAVGGVNFVLTQPRANVDLGVGFTAAYAAAALRTPVTDMGNLPQNLYLTRGTIPMLDGDADAYLRRVVNTGNRLGPQGPRPIFGQLMPATPAGVAHGQAAVCEFIVTPVSADLNYFRRPCNPRGRSAGPVYACDGEADAVDVMYDHTQGDPAYPSRATVNPWASQRNSYGDRLYNGKYNLNGASPVYSPCFKFFTPTEVEAKGRNMTQLIADVGASVAPSTSNTEIQFKRPHGSTDLVEDPCSLFQEAYPLLSSTDTALLRTPHIGEIGADEGHFAQYLIRDESPLKGCFPRI

SEQ ID NO: 201 - protein, 314 aa, Equine herpesvirus 1
MASAAFEIDILLPSDLSPADLSALQKCEGKLVFLTALRRRVMLSSVTLSSYYVNGAPPDTLSLMAAFRRRFPAIIQRVLPNKMIAAALGVAPLPPGAFIQNTGPFDLCNGDSVCALPPILDVEDKLRLGSVGEEILFPLTVPLAQARELIARLVARAVQALTPNAQAQRGAEVMFYNGRKYNVTPDLRHRDAVNGVARSLVLNMIFAMNEGSLVLLSLIPNLLTLGTQDGFVNAIIQMGSATREVGQLVHQQPVPQPQDGARRFCVYDALMSWISVASRLGDVVGGKPLVRICTFEGQATISRGEKAPVIQTLL

SEQ ID NO: 202 - protein, 734 aa, Equine herpesvirus 1
MFGRVLGRETVQYFEALRREVQARRGAKNRAAEAQNGGEDDAKTAFLNFAIPTPQRHQTVVPGVGTLHDCCETAQIFASVARRLLFRSLSKWQSGEARERLDPASVEAYVDPKVRQALKTISFVEYSDDEARSCRNAYYSIMNTFDALRSSDAFHQVASFVARFSRLVDTSFNGADLDGDGQQASKRARVDVPTYGKQRGTLELFQKMILMHATYFIAAVILGDHADRIGAFLKMVFNTPEFSDATIRHFRQRATVFLVPRRHGKTWFLVPLIALALATFKGIKIGYTAHIRKATEPVFDEIGARLRQWFGNSPVDHVKGENISFSFPDGSKSTIVFASSHNTNGIRGQDFNLLFVDEANFIRPEAVQTIIGFLNQTNCKIIFVSSTNTGKASTSFLYNLKGAADDLLNVVTYICDEHMERVKAHTNATACSCYILNKPVFITMDGAMRNTAELFLPDSFMQEIIGGGNVSGAHRDEPVFTKTAQDRFLLYRPSTVANQDIMSSDLYVYVDPAFTTNAMASGTGVAVVGRYRSNWVVFGMEHFFLSALTGSSAELIARCVAQCLAQVFAIHKRPFDSVRVAVEGNSSQDAAVAIATNIQLELNTLRRADVVPMPGAVLFYHCTPHGSSVAYPFFLLQKQKTGAFDHFIKAFNSGSVLASQELVSNTVRLQTDPVEYLLTQMKNLTEVVTGTSETRVFTGKRNGASDDMLVALVMAVYLSSLPPTSDAFSSLPAQ

SEQ ID NO: 203 - protein, 706 aa, Equine herpesvirus 1
MDAHIANETKHLLVHGNSKTRALVHIIVPDACLKKAGVDPVKLSDRHRASPSAAPVFRVFAQTRYHATGECSLWRTVFAGYVPSGAIVSALVPTVPADHPRLFQSTPDSGGLFVSLEIECDADGRFDAFTLVALRVDIADDPRTTEVLFTYDELLPPGTRYGADSKRVALLCRQFVAYVNSHPTVSQSAVTAASHIEAAVAEDVKSASGPQVSYGARIDPAEYLFSGGGFDNHQALARLEDDDKEIMSLIRRASEVIAKRNPVRVLSNPEVNGDAHRRQCVASGLRQGARGAHASDSHARVGFNSSIHDATALLLGLEPPDSGRFVNSGPQRHLPPQGPRSPASRDCQSGMLDDVLLLTPENSNPLTPLDWLDVGHAAVAGGDTPRDVWRRRPISLVARKHYGTCETFVVVSYENSTAWGGRRARDEHLAGSINPPVMQACVAAGVDHPRNLPPETRGELIAKFPMLTVPLGDTPPPVAAFDAAAELALIDHFRGACVSALLKAISERLRAEPRMSQLIEYDIPNNNRDCIISVAQRAPELLEAVALAIQNVTVTEFCNSALMLSALSHLNILSGNKRGRLPYHRSWLPSLAGGADAFLFDYYSSGGEVVKVSPVPLAILVTATRTGQHSCRFARGAPDSSSKTYERYLPGECYAYICVGLNRSFEALVVLPGGFACRASAARKLAWPAHLVEPILERYCWTIPSH

SEQ ID NO: 204 - protein, 370 aa, Equine herpesvirus 1
MMAAASDSCLSLWEGSASSPNRQLTPEAVNCLTEALTEDVAVLRLIRSDPRVKIFMAVSVLTPRLARFAPPPPKLTHTAKCAVIMIYLTRPKALALQPKQFHMLVTFNKASVYSLVVRVKTKPFPVGTQRFRAVFQDPEFIGLPSDIPDPAAENIPTEINDRLDVSNFATPAQPPKDKYDCCVLAPGVWWSNANKAIYFLQMDVALLALCPAGWKARGLGIILGRLLNHQEGCATCRFTEHSDPLNATADSVATPESCLCWAPCLWRKAHQRELTVEGDRYLFRVLFMDAVERVRLTGLRRSPKITANLADLVVGIGPHGQQIPVNNAGWKLVALDADISRLIVCGCYALRYICPPTNSKHQPSSPDEYA

SEQ ID NO: 205 - protein, 317 aa, Equine herpesvirus 1
MSFSARSRRQRLQLEEAYQREMIFKMHTLDLVREGVNKRSPAFVRAFTSAKEASLDLDRYMQAHSRVGRVEQNARALAQRVEAQAAVGEILDRHRRFLHPDFIDNFDSREDSIVEREERLGDVLSDINCDGGGGEVGDPQEWLGHEDEALLMRWMLEEAPRVSTRIAADPHSPRSTCPAPRKAPEDARCGARKPGEVNNYTPSAQPRSQETTVDHLASPDEGTRLGDRTRDLEHHSTAPMRTHPNVLASERRRLGVVHQREKSSESQESATRSKAIVGQEDQKWLGGIPPLSDEELQVDMGIPTMNGPIYPDYHRTA

SEQ ID NO: 206 - protein, 594 aa, Equine herpesvirus 1
MARSRRRSSVDEMDVGGSATSEYENCGGPSFSPLNLSRPKKSTRGRSLRSAQAWGGKQLHPERSTPLARNDCGPSSKPRRRHEVGRSNKGLGASLDRTDEDTSQCPRIRASAIRCGASTRKIVRITGECDAQQGDSRPGRSEMAGWHSPPKRRRTPSRHGNSDNERSHLPRLSSHGVVRVGGRPLTQTPLQKTIILQPKLVRKVFMPTFTVNPEMHYRRVALGEIPKFGGAGSYGEVQIFKQTGLAIKTASSRSCFEHELAVSLLTGECSLRAQASLGIGGIICLMAFSLPSKQMVFPAYDADLNAYGYRLSRSGPPSVLVTESIERAFIGLGRALVYLNTSCGLTHLDVKGGNIFVNHSHFVISDCVIGDLSLMTLNTNSMAMRAEFEIDTGEEEIKTLRLPRSASQMTFSFVIGHGLNQPISVIADFINNSGLAKSTGPIKHDVGLTIDLYALGQALLELLLVGCISPCLSVPILRTATYYYYSNKLSVDYALDLLAYRCSLYPALFPTTPLTTIYGIPWDQVEGVFESIAGAHHREAFRAHLERYRLTHRRLFASIRIPSAFTGVLELVSLLCHANEKARLSIPLLWTPRP

SEQ ID NO: 207 - protein, 565 aa, Equine herpesvirus 1
MDSSPVTYSGEPPYKLRRLSPSYPYVSKLRERCASKIETLSEGSARDSLEEEDVSEAMATGAFLATRLYLPSVLPQRITTLTFLDHFKKSRPLPNSDKRLNPIFYRLAYIRDLVGEMELEGIVERGTASRLLGASSPAGFVAGTYTHARDLSKTMSLASVRDAVLAIEAQTRDQSESQLWALLRRGLATASTMKWGALGPQYHPQWCEVSTNAKGIPNNPALQFGQTNERTARSLISALYVARSEAATPDLLVDPGCGQCFVFDESASVPGDAYACGLLMDARTGVVGASLDMLVCDRDPSGVLSPHSTQTTLDFFEIKCRAKYLFDPDLFSPVATAYANLLKHRTAVCLRKFLRSIKNPAVEYFAPTSVPGATEALITCNSSWKPREVNETNRRCGDFDRDHIALNLDASSDVWLFSEPDLESETITPARWDTGELALSVPVFANPRHPNFKQILVQAYVLSGHFPDHQLRPFLVTFIGRHRKRCEEGKTFTICDRPEGSPYNLNEVVHSSCAIPILLFVTPVIVDREGCWEDIEIESLTAFNKTADAIWDSDSPADVSEPTSS

SEQ ID NO: 208 - protein, 74 aa, Equine herpesvirus 1
MGQRLSCGCFRTDQLVTHSGEVVSLNADTFEEFSMEEFDIPPPPPLPKPVFKQPGPYKIPARSQRCPSKRRDPY

SEQ ID NO: 209 - protein, 450 aa, Equine herpesvirus 1
MARRGAAVAEEPLLPSSGIVGIGPIEGINWRTWLVQVFCFALTTSVLFITLVTASLPQTGYPCFYGSLVDYTQKNHSVVDGVWMRQIAGGVAPTLFLETTSLVAFLYYTTLVLVAISFYLIISAVLVRRYARGKECTAVAGCTRPTTTLIASHVTLVLGTLATWLLQVVILLLSHKQAVLGAAVYVVHFVSLVFFCMSFSGLGTASAQYSSNLRILKTNLPALHKMAGPGRAVMTNLGMGMLGISLPILSLMLGIILANSFHITLWQTVTVAVGVFVALGLMFLIIVELIVSHYVHVLVGPALAVLVASSTLAVATHSYFVHFHAMVSVQAPNLATASKAIVGIMAVISIIMLVVRLVRAIMFHKKRNTEFYGRVKTVSSKARRYANKVRGPRRNPQPLNVAESRGMLLAEDSETDAEEPIYDVVSEEFETEYYDDPQRVPERSHRREYR

SEQ ID NO: 210 - protein, 887 aa, Equine herpesvirus 1
MPSIGPIPTIPDEGSRGSSATAAPRRAMASYRDTTLGGRAEGVAFSAVEDSYTSSVSLARMLYGGDLEEWVRHTRPGVSLEIQSRAPVRFPPPNNPSSRRVTVVRAPMGSGKTTALLKWLGEALDAPDISALVVSCRRSFTRTLAKRFNDAELPGFATYFTSTDYTMAGEPFRRLLVQIESLHRVDDNLLNNYDILVLDEVMSTIGQLYSPTMVHLNKVDALLTRLLKTCPRVIAMDATANAQLVDFLASARGERSVHVIINSFAAPGFSQRDGTLLRTLGTDVLRAALGFVLVDDENGTKVMETDSRPISARLREVNSAGFFGRLMDRLVAGRNVCVFSSTVSFSEIVARFCSQFTDSILVLNSLRPSEDVAFWGGVRVLIYTTVVTVGLSFDTAHFHSMFAYVKPMSHGPDMVSVYQSLGRVRELIHNELLVYVDSSGARAEPIFTPMLLNHVVSRQGGWPAEFSQVTDALCCQFKARCGPAYRTASTRGLALFVRFKYKHFFERCTLASVGDSINILYTLLESNQMRVAIEGCQFPLTAAGFCDFLQDLRLDAYAARKEIKQLRGPGGIAATPTEVFENDDVAVFIQKYLRPGVAHDEILALLVELNSPIVREQFVNVAVLGACLRLPAALESPEVFAGVYKHYASGVVPVISDAGALESVSITPDVNVLARWDLYKSCTRHARDLAWDPSRGGSGLDMSEDFITNTLSADYNRFQSLLVEIAKCNVTPLEMLAAGAVRGVTTALSGRPKSRVPLSKGEHAVSLFKVLWEDVFGAKLAKSTQTFPGGVRVKNLRKDEIVALLESVNVNHSECKTHRELYALLMCNRKLFAGPRYKLRAPKWSRNLCFLELDNTGTCKTPLDAALADLAPSAWPQVYGAVDFDAL

SEQ ID NO: 211 - protein, 716 aa, Equine herpesvirus 1
MLCRRGSDYTAEFCHVPVSGELLKRGARDASLVTPARVASAAQTAAVPGCWPLAPLGNAMLWKSVYGGITAALKRAVGSFAFYQPLVLGINTQTGLLVTLRPAASAGEGGGDHVSPRAAIVNVSVEVDLDPAGIEASAASSTGSSLARARLCTLRDGYFLSKRDIALEVEIATKEVSFYRKYDSVQQPANKRRGDMADLFVVHERTLLLGGCKRMGVKVLLPRTFDCLVASSQSVSGLAAMALYKQWHATLFSVELPDTVVQIFAYLGPELNPCGEEVDYCCFVGFPGLPTLKASSSTTEAVRDAMAAYRLSDGLWPALGMSAFHFLAPWDPEDRWPGESEAKRVEGAVHRLQLGTEDDWGAGRVSCILESDAVMQGPWFAKFDFSAFFPTLYLLLFPANERLAEVVRLRARGQHPTLKLALVSFFGGLQHINPVAYRSIIALSNGISKRLEHEVNQRGFAICTYVKDGFWGAAGNLPSDSVSYADALVYAEELRSAAQKAALGHVSEMGFSLPEGVHLNLRLEGLFTDAISWSTHCYWLYNRFTKMEDFVGFPAKSGAGRAAKASLSALLPLVAAVCDSSDMSTLHQSVRGACEQLVAGAFAERNNPQFWSTRTGIESSTLLPPAVYRNGSLLDRDCGQREIVLTRKHDCESPSPVPWTLFPPPLVLGRIDCMVYLTSIFKTYLSMLNRAISASCDADESMNVDFPISDYAFLFT

SEQ ID NO: 212 - protein, 303 aa, Equine herpesvirus 1
MSATMRAEIDPLAHSATVDEMVEAITKGDDSVTTIVDDLVWHATPRFVTEVREVPGLPPSFTTTSVTDMRVDASSEKLMLTLDGQEGSEISCETYMRSCLDLPAFKGFSLFVVTPLEDRVNVLGVAPVILSHRLVLYRPTDLIDFTLCIIQMYLENCSTKRATSSLFVQIECILRNISKTITPLLKMRRLMYIGATWTLNTLMCVTNHNPFDQARVLPNYMMAKMLLGQKSNTPAILDAIYSAGYRQTLSKRPITPCPSGVLRCNKAHLNAPLCTKVVADTLYSWWTATDEKPVPESIYVLYD

SEQ ID NO: 213 - protein, 753 aa, Equine herpesvirus 1
MSADSIEPKQKRLRYADANKGRKVERKNTPRFEATTGLQSPGEEEQISADGGWVLIHPTPKTMLFKEILMGELGYTEGQGVYNAIRSTEAAIRQIQTTILTNTLNATRYEDLAKDWQTHLDSRGVSAEEIAATYGMYSEGEAVRVAEQIFATWHRTLQMSLLDFVRSITACFSASEPDGTASFAKYIDWIACLGLIPLQRLKRAPGATVHPKLWRKLPTDVPSLESCVDERDLAGKLYVANSLLREGLEAVVELARCTASVAIMDYDRVNIFYHYTRREVVAIDSTTGKRGECLVLWQPIWKDGSVLFDSPLQRICGEVCNCHALREHAKLCQLLNTVPVKILVGRKKDEAQGPGWASKAVDKLMGEGEELHSSSAASRLVKLIVNMKSMRHIGDITETVRSYLNETSTNLLSGAQVDTSLPGFGQSGKTKQGGNMPVQEAFRTSVINGINGMLEGYVNNLFKTIEDLRTGNSGLLDQLRDRESEITHLREQLLRVSQAAADGSTQPGASSAALPGSGAKSGAGGLGHEVIDIRNLMGDDGYVANSFQSRYIPAYTADMERLSRLWDQELLRCFKMNRITNNQGQEMSVSYSNSSISLLLAPYFFSILRARHLGFLITHQEAYRSEEELCVAVFKKTRLEAYLTELSTLFVARVRNSIAALNSTKRDLPVNDNEAQSDEEQLGKPSDERYYEGRDRSASPQRDRGRNGRGYHKRRRFSNNYRRRSGLARDSSIRDRSQRGSRPTPLLHDHVGH

SEQ ID NO: 214 - protein, 881 aa, Equine herpesvirus 1
MESADILPGSRGTVDRRCEGSEEKITPPRPVEDFNPQLFPNEVYLNFTSMHGIQPVVARIRELSRKTVSAAMVPPLEWFERLPRLETPLDIEPLHLPFSVYLISGNAGSGKSTCIQTLNETMDCVITGATRVAAQNVYTKLSSAFATRHINTIFQEFGFRGNHVQAQLGKYQYSCSSSPPPIEELQKRDIVYYWEVLVDITRRLFESTASRGEFENIRALERLLGRAPGSLTRLAFCTNGSLPAFTRTNIVIIDEAGLLGRHLLTVVVYCWWMLNAAYKSPQYAEGKVPVIVCVGSPTQTDSLESRFEHKNLKCHVRSSENVLTHIITNRTIREYVSLSTNWAIFINNKRCQEYEFGELMKVLEYGLPITEEHMRLVDTFVVPEAYINNPANLPGWTRLYSSHKEVSAYMAKLHAHLKVSGERQFVVFTLPAYTFVKTAAFDEYKKITQQPSLSLDKWLAANASRVSNYSQSRDQDAGKTQCEYYSEHGVVVARTDVTYVLNSQVSVTTRMRKFVFGFSGTFETFDAVLKDDAFIKTQGETSVEYAYRFLSTLLFSGMINFYNFLKRPGLDEGRVREAYRRMAALTAKLIPGASVLESACDNPSGAPLNFRGLTDPPGFTGGTTNDWDDDNDVVFAALNEGAIDMLYCNYEFVRPETTQEVYSQFLMLKTMFVGRYSIFMDLFGGDFESSPFDTFVDNISYKGCEIFVGSMRGGVSSIALQTDSYTLMGYTSAPVYPFVEELARRKLHEGIAELFGAMNMPRMVLRDQHGFMSVLNVNLSEFVESVDDVELDMATAVDYGLSSKLAMTIARSQGLSLDKVAICFPRNNLRINSVYVAMSRTVSSRFLRMNLNPLRERHERDTVISEHILAALRDRDVQIVY

SEQ ID NO: 215 - protein, 225 aa, Equine herpesvirus 1
METCSPPVTFITYALYGIKTSPAWTLPNFEQVICSCDWGYRLIAVGAESKCDVTPQGSFVIQHGASITALVLDCGVEFCSYAFTHAENTRVPLTTEDGSVLVVPFCGWVCVGRDRCLRSMSGGVLTISWDTSQTAYISVAVYRPPTLQCHALDCTRAETTVCSTAAITDASESDPLYADQEGDQTQDQDGGHDFLETILMESDLYGTNGASALLEPCFPCLSNND

SEQ ID NO: 216 - protein, 179 aa, Equine herpesvirus 1
MDVFGRGRAATADDYRRFLERNSRAAAKLAAATTPTHTASSRQQPEVSARPRHRSLSSRRNSVPHYDPHAGAGGDGQLALSERPSGTLGALAMAAQRRKSIGRPDTPVNAAMGSALRSSQRPRGDVRNPRGEGQTQRGGSRGEANHAQRRQSVTQSTAARQTQPHQGRPRPRRNTLRHM

SEQ ID NO: 217 - protein, 212 aa, Equine herpesvirus 1
MESALTVLSGWGWPVEVVTGPVADHLTEMRPPAPTGTTCTTTSTPTPLCVPDLSVESIKGLAPDGENANYVGFDTMFMVSSIDELGRRQLTDTIRKDLRVTLAKFTIACTKTSSFSSASSTRRRKRHCPSSERVMRSNKSLQMFVLCRRAHAKQIRDQLQSVIQARKPRKYYTRSSDGRTHPVVPVYIYEFSAVDKVYLHRDNVIEADAQAK

SEQ ID NO: 218 - protein, 312 aa, Equine herpesvirus 1
MSSACDHETEASHVNIPETTPEENGSNSSTPTSEIGPACVVSPAPGETGAPPPKRRRPCGLPQGVALINTSVSTHPLFTTSCQSSWEDVEREFNIAPSWRPILEREMQQPYVRLLLNEYKLRCASEEVFPPKEDIFAWTRFSPPEKVRVVIVGQDPYHAPGQAHGLAFSVRKGVPVPPSLRNIYSAVQKSYPSFRHPMHGFLERWAEQGVLLINTTLTVARGKPGSHATLGWHRLVRAVIDRLCTTSQGLVFMLWGAHAQKSCSPNRQHHLVLTYGHPSPLSRVNFRDCPHFLEANAYLTKTGRKPVDWQIE

SEQ ID NO: 219 - protein, 218 aa, Equine herpesvirus 1
MYQILIGCVWQKSPYINQCTEFQPPLSFVTPERMRRFMRCWARLELVYMLAWIVTTKLVKATRLDFTWGPGEPKRILEASCGSGPIMKGQLFTSPNIKNLLNRTTGIMVKAHCNPPEAILWVDTPPKPVWVNPFAVVQGLAEDVTNGNMPQDFKEKLLFALDDSLSQSQSSPDEILGPPPLGCFTGPFFLSPPKSKDIAEGLKDSCIPASYYANLQKT

SEQ ID NO: 220 - protein, 218 aa, Equine herpesvirus 1; identical to SEQ ID NO: 219

SEQ ID NO: 221 - protein, 1487 aa, Equine herpesvirus 1
MASQRSDFAPDLYDFIESNDFGEDPLIRAASAAEEGFTQPAAPDLLYGSQNMFGVDDAPLSTPAVVIPPPSPTPEPRGGKAKRSPSAAGSGGPPTPAAAAQPASPAPSPAPGLAAMLKMVHSSVAPGNGRRATGSSSPGGGDAADPVALDSDTETCPGSPQPEFPSSASPGGGSPAPRVRSISISSSSSSSSSMDEDDQADGAGASSSSSSSSDDSDSDEGGEEETPRPRHSQNAAKTPSAAGSPGPSSGGDRPAAGAATPKSCRSGAASPGAPAPAPASAPAPSRPGGGLLPPGARILEYLEGVREANLAKTLERPEPPAGMASPPGRSPHRLPKDQRPKSALAGASKRKRANPRPIPQTQTQAPAEEAPQTAVWDLLDMNSSQATGAAAAAASAPAAASCAPGVYQREPLLTPSGDPWPGSDPPPMGRVRYGGTGDSRDGLWDDPEIVLAASRYAEAQAPVPVFVPEMGDSTKQYNALVRMVFESREAMSWLQNSKLSGQDQNLAQFCQKFIHAPRGHGSFITGSVANPLPHIGDAMAAGNALWALPHAAASVAMSRRYDRTQKSFILQSLRRAYADMAYPRDEAGRPDSLAAVAGYPAQAAAAAASQQQPEAPAPSVRVREAYTRVCAALGPRRKAAAAAAAPGTRAPRPSAFRLRELGDACVLACQAVFEALLRLRGGASAVPGLDPSEIPSPACPPEALCSNPAGLETAALSLYELRDLVERARLLGDSDPTHRLGSDELRLAVRAVLVVARTVAPLVRYNAEGARARASAWTVTQAVFSIPSLVGGMLGEAVSLLAPPTRSQQPSSSSPGGEPFSGSAAAEGSLQTLPPLWPTVPGKQSATVPSSHSQSPQHSQSGGGAGATTATCCRATQTNARSRGQQHQPQKARSPQAAASPAHLSQEAMPGSSSDDRAIHGRPRGKSGKRRSEPLEPAAQAGASASFSSSARGYDPSGPVDSPPAPKRRVATPGHQAPRALGPMPAEGPDRRGGFRRVPRGDCHTPRPSDAACAAYCPPELVAELIDNQLFPEAWRPALTFDPQALATIAARCSGPPARDGARFGELAASGPLRRRAAWMHQIPDPEDVKVVVLYSPLQDEDLLGGLPASRPGGSRREPLWSDLKGGLSALLAALGNRILTKRSHAWAGNWTGAPDVSALNAQGVLLLSTGDLAFTGCVEYLCLRLGSARRKLLVLDAVSTEDWPQDGPAISQYHIYMRAALTPRVACAVRWPRERHLSRAVLTSSTLFGPGLFARAEAAFARLYPDSAPLRLCRSSNVAYTVDTRAGERTRVPLAPREYRQRVLPDYDGCKDMRAQAEGLGFHDPDFEEGAAQSHRAANRWGLGAWLRPVYLACGRRGAGAVEPSELLIPELLSEFCRVALLEPDAEAEPLVLPITEAPRRRAPRVDWEPGFGSRSTSVLHMGATELCLPEPDDELEIDGAGDVELVVEHPGPSPGVAQALRRAPIKIEVVSDDEDGGDWCNPYLS

SEQ ID NO: 222 - protein, 293 aa, Equine herpesvirus 1
MPHGQPCGACDGSCRMAQRGTPSTSPLIPSLTPSPPAGDPSPRSSQRIDAVRVPARLPGGSDHPEYGMPLSPRALRPYLARGPGAFCAPPWRPDVNRLAGDVNRLFRGISTSSIHVTEDSRTLRRALLDFYAMGYTHTRPTLECWQSLLQLLPEQSFPLRATLRALNSEDRYEQRFLEPPSDPPNTLFGEECDVSGDESPSEEEEEDEASGESSVSEFSPEEETASSEYDSFSDVGEDDSSCTGKWSSSESESDSESDAPTNNHHPTTRASAAKKRRKRQPPKGERPTKSARR

SEQ ID NO: 223 - protein, 236 aa, Equine herpesvirus 1
MDGAYGHVHNGSPMAVDGEESGAGTGTGAGADGLYPTSTDTAAHAVSLPRSVGDFAAVVRAVSAEAADALRSGAGPPAEAWPRVYRMFCDMFGRYAASPMPVFHSADPLRRAVGRYLVDLGAAPVETHAELSGRMLFCAYWCCLGHAFACSRPQMYERACARFFETRLGIGETPPADAERYWAALLNMAGAEPELFPRHAAAAAYLRARGRKLPLQLPSAHRTAKTVAVTGQSINF

SEQ ID NO: 224 - protein, 272 aa, Equine herpesvirus 1
MNSDMMTAATAGTEVFRCALARRRNANPPHLVLAPTFAAAAAGGAANSSGEEAPRGERKHLFNPFGCMLGRSYFRRCREEMNEGYFAKVPTGYFPVAPSEVPCRVPVEGVVAGEVLSYSALPLPKIEKRFYKQLNDGTFVRLPFLYPEVYYEGEEEPADERYYIRADAADASSADPSTLPEEAFAKVPPAIAEGITNWQGPKRIPIPSERYVMKLGFEYQLHVTEDAFQEVNTSFMRLDLQSSPDPHPRGARQPRSRAHVSAENPEDTPVAV

SEQ ID NO: 225 - protein, 418 aa, Equine herpesvirus 1
MGVVLITVVTVVDRHKALPNSSIDVDGHLWEFLSRQCFVLASEPLGIPIVVRSADLYRFSSSLLTLPKACRPIVRTRGATAIALDRNGVVYHEDRMGVSIEWLSVLSGYNHLNSSLIINQPYHLWVLGAADLCKPVFDLIPGPKRMVYAEIADEFHKSWQPPFVCGKLFETIPWTTVEHNHPLKLRAAGGEDTVVGECGFSKHSSNSLVRPPTVKRVIYAVVDPARLREIPAPGRPLPRRRPSEGGDARPEAALARSRARSVHGRRRDAAPPRGPAGARRPPGGRRDVDGTPTLGSVRPDIHTLKGRGLSPVPHLALWVEQWFLALQKPRLYTHHRLALHNIPSILKGEKREDTFEDNRRDELRHDDSRHRRHRGLPLRARSPPQCQPAPPRLGPHLRRSRGRGGRQLQRRGGAERRA

SEQ ID NO: 226 - protein, 382 aa, Equine herpesvirus 1
MENKQCDHLTDWFSTTSDASESMDTTPPLPPPTPSVDPSYSGAAADEDLYSDISEGDLEYSDCDSASESDEDDDDCLIPSKEKAREVAASFGYTVIKTLTPGSEGRVMVATKDGQPEPVVLKIGQKGTTLIEAMMLRNVNHPSVIQMKDTLVSGAITCMVLPHYSSDLYTFLTKESRRIPIDQALIIEKQILEGLRYLHAQRIIHRDVKTENIFINSVDQVCIADFGAAQFPVVEPADLGLAGTVETNAPEVLARAKYNSKADIWSAGIVLFEMLAYPSTLFEDPPSTPEEYVKSCHSQLLKIISTLKINPEEFPRDPGSRLVRGYIEYSRLERKPYTRYPCFQRVNLHIDGEFLVHKMLAFNAAMRPSAEELLSYPMFAQL

SEQ ID NO: 227 - protein, 411 aa, Equine herpesvirus 1
MLTVLAALSLLSLLTSATGRLAPDELCYAEPRRTGSPPNTQPERPPVIFEPPTIAIKAESKGCELILLDPPIDVSYRREDKVNASIAWFFDFGACRMPIAYREYYGCIGNAVPSPETCDAYSFTLIRTEGIVEFTIVNMSLLFQPGIYDSGNFIYSVLLDYHIFTGRVTLEVEKDTNYPCGMIHGLTAYGNINVDETMDNASPHPRAVGCFPEPIDNEAWANVTFTELGIPDPNSFLDDEGDYPNISDCHSWESYTYPNTLRQATGPQTLLVGAVGLRILAQAWKFVGDETYDTIRAEAKNLETHVPSSAAESSLENQSTQEESNSPEVAHLRSVNSDDSTHTGGASNGIQDCDSQLKTVYACLALIGLGTCAMIGLIVYICVLRSKLSSRNFSRAQNVKHRNYQRLEYVA

SEQ ID NO: 228 - protein, 797 aa, Equine herpesvirus 1
MGFIYARKLLLCMAVSIYAIGSTTTTETTTSSSSTSGSGQSTSSGTTNSSSSPTTSPPTTSSSPPTSTHTSSPSSTSTQSSSTAATSSSAPSTASSTTSIPTSTSTETTTTTPTASTTTPTTTTAAPTTAATTTAVTTAASTSAETTTATATATSTPTTTTPTSTTTTTATTTVPTTASTTTDTTTAATTTAATTTAATTTAATTTAATTTAATTTAATTTAATTSSATTAATTTAATTTAATTTAATTTAATTTAATTTGSPTSGSTSTTGASTSTPSASTATSATPTSTSTSAAATTSTPTPTSAATSAESTTEAPTSTPTTDTTTPSEATTATTSPESTTVSASTTSATTTAFTTESHTSPDSSTGSTSTAEPSSTFTLTPSTATPSTDQFTGSSASTESDSTDSSTVPTTGTESITESSSTTEASTNLGSSTYESTEALETPDGNTTSGNTTPSPSPRTPSFADTQQTPDNGVSTQHTTINDHTTANAQKHAGHHRGRAGGRRGSPQGGSHTTPHPDRLTPSPDDTYDDDTNHPNGRNNSIEIVPQLPPDRPIIELGVATLRKNFMEASCTVETNSGLAIFWKIGNASVDAFNRGTTHTRLMRNGVPVYALVSTLRVPWLNVIPLTKITCAACPTNLVAGDGVDLNSCTTKSTTIPCPGQQRTHIFFSAKGDRAVCITSELVSQPTITWSVGSDRLRNDGFSQTWYGIQPGVCGILRSEVRIHRTTWRFGSTSKDYLCEVSASDSKTSDYKVLPNAHSTSNFALVAATTLTVTILCLLCCLYCMLTRPRASVY

SEQ ID NO: 229 - protein, 452 aa, Equine herpesvirus 1
MPAVLLVLYVNPPPSVCILTQKLSLGLYNQWWRVCRSVPPPWYVFFNKRSMSTFKLMMDGRLVFAMAIAILSVVLSCGTCEKAKRAVRGRQDRPKEFPPPRYNYTILTRYNATALASPFINDQVKNVDLRIVTATRPCEMIALIAKTNIDSILKELAAAQKTYSARLTWFKIMPTCATPIHDVSYMKCNPKLSFAMCDERSDILWQASLITMAAETDDELGLVLAAPAHSASGLYRRVIEIDGRRIYTDFSVTIPSERCPIAFEQNFGNPDRCKTPEQYSRGEVFTRRFLGEFNFPQGEHMTWLKFWFVYDGGNLPVQFYEAQAFARPVPPDNHPGFDSVESEITQNKTDPKPGQADPKPNQPFKWPSIKHLAPRLDEVDEVIEPVTKPPKTSKSNSTFVGISVGLGIAGLVLVGVILYVCLRRKKELKKSAQNGLTRLRSTFKDVKYTQLP

SEQ ID NO: 230 - protein, 424 aa, Equine herpesvirus 1
MAKLTGMFSAAILLSMAICSTAIIYRGEHMSMYLNASSEFAVYPTDQSLVLVGHLLFLDGQRLPTTNYSGLIELIHYNYSSVCYTVIQTISYESCPRVANNAFRSCLHKTSKHYHDYFRVNASVETNVLLNITKPQPTDSGAYILRVKLDHAPTADVFGVSAFVYDLKSKTVPDPMPTTQTVEPTTSYVSTPTYDYTDDVTTETESTSTSTQQAMTSTQTPSATWGTQLTTELPTNETVVIGQEALLCHWFQPSTRVPTLYLHLLGRTGNLPEDVLLVEDSEFLRTTSPAHRPSASPADGDDFKQTNSTSLKARNKIVAMVVIPTACVLMLLLVVVGAIINGAVRKHLLSCASRRIYRSGQGGASAAERRRLTCGPTLAASSESLADDTTSSPPTPKPSKKTKLETDPLMEQLNRKLEAIKEES

SEQ ID NO: 231 - protein, 550 aa, Equine herpesvirus 1
MELLAASRACIFFGLVTVLDAWGVQQVELSEGAWAMIDGRDVLTPTNTTTRVTKAWTFLETPPGCAGDISVKKVCVSHSLCEDNIIIGKHCNLLTGEHGIALAEFNVVNGSLRRTDDVYFVNGTVFPILAETRSVLQIHRATPSIAGVYTLHVSIDGMMKHSVVLLTVKKPPKQPQPRLRVKTPPPVTVPQVPVKTHTDFVVHGYHSRVYADGESFELSVNLESHIVEPSFSAEIQWYYMNTSSSSCDLFRVFETCIFHPTAMACLHPEQHTCSFTSPIRATKILHRVYGNCSDHGNSWPSRCHSTLLGNRLYFIQPAQNRVDLLFKDTPASATGLYVFVLLYNGHPEAWTYTLLSTANHFMNVLTDVTRPRLGEHFYTDLGHKIITPHPSVATTEELGAWTRHYLAFLLVIICTCAALLVALVVWGCILYIRSNRKPYEVLNPFETVYTSVPSNDPSDEVLVFERLASDSDDSFDSDSDEELEYPPPPKPAPQLPPYQFVDGGDAPSGRSGFKVWFRDTPEASPVPLHKPTLQGPDYSRVASKLKSILK

SEQ ID NO: 232 - protein, 130 aa, Equine herpesvirus 1
MSSNSDNTECFGGVNYAEGMRKRKRNPVRNSTFQEYLDARNARYPRSGSTSDSDEDYTTRSKYESDVSEFKKMMDLETLPPPKAEPQAQKAEPDAAKEEPVSTTSYILNEWVAPMIGHFLAMCMYELLFK

SEQ ID NO: 233 - protein, 219 aa, Equine herpesvirus 1
MEKAEAAAVVIPLSVSNPSYRGSGMSDQEVSEEQSAGDAWVSAAMAAAEAVAAAATSTGIDNTNDYTYTAASENGDPGFTLGDNTYGPNGAASGCPSPPSPEVVGLEMVVVSSLAPEIAAAVPADTIFASAAAPATRVDDGNAPLLGPGQAQDYDSESGCYYSESDNETASMFIRRVGRRQARRHRRRRVALTVAGVILVVVLCAISGIVGAFLARVFP

SEQ ID NO: 234 - protein, 272 aa, Equine herpesvirus 1; identical to SEQ ID NO: 224

SEQ ID NO: 235 - protein, 236 aa, Equine herpesvirus 1; identical to SEQ ID NO: 223

SEQ ID NO: 236 - protein, 293 aa, Equine herpesvirus 1; identical to SEQ ID NO: 222

SEQ ID NO: 237 - protein, 1487 aa, Equine herpesvirus 1; identical to SEQ ID NO: 221

SEQ ID NO: 238 - protein, 360 aa, African swine fever virus
MPSTLQALTKKVLATQPVLKDDYCILERCGLWWHEAPITIYHTCIDEQILIKTASFKHGLTLNVALMKAVQENNHGLIELFTEWGADISFGLVTVNMECTRTYAKVRCEEKALSENKILEIFYNVQYVKTSSNIILCHELLSDNPLFLNNAQLKLRIFGELDTLSINFTLDNISFNEMLTRYWYSMAILYKLTEAIQYFYQRYSHFKDWRLICGVAYNNVFDLHEIYNKEKTNIDIDEMMQLACMYDCNYTTIYYCFMLGADINRAMITSVMNFCEGNLFLCIDLGADAFEESMEIASQTNNWILINILLFKNYSPDSSLLSIKTTDPEKINALLDEEKYKSKNMLIYEESLFHIYGVNI

SEQ ID NO: 239 - protein, 362 aa, African swine fever virus
MSTPISLQALAKKILATQHISKEHYFILKYCGLWWHGAPIMLSTNEDNQLMIKSAIFKDGLELNLALMKTVQENNYDLIELFTEWGADINSSLVTVNTEHTWNFCRELGAKILNEMDIVQIFYKIHRIKTSSNIILCHKLLSNNPLFQNIEELKVIICCFLEKISINFILNEITFNEMLTRYWYSIAILCKLTEAIQYFYQRYSHFKDWRLICGLSFNNVSDLHEMYHIKKVDMNIDEMIYLACMRDSNFLTIYYCFVLGADINRAMVTSVKNFYMNNLFFCIDLGANAFEESLELAKQKNHDILVEILSFKDYYSSNVSLLSLKTTDPEKINALLKNYRSKNIMRYKKLCPEIIRWARFII

SEQ ID NO: 240 - protein, 189 aa, African swine fever virus
MRSSKKINNKKNMFNIKMTISTLLIALIILLIIILVVFLYYKKQQPPKKVCKVDKDCGSGEHCVRGSCSSLSCLDAVKMDKRNIKIDSKISSCEFTPNFYRFTDTAADEQQEFGKTRHPIKITPSPSESHSPQEVCEKYCSWGTDDCTGWEYVGDEKEGTCYVYNNPHHPVLKYGKDHIIALPRNHKHA

SEQ ID NO: 241 - protein, 81 aa, African swine fever virus
MDTSLKNNDGALEADNKNYQDYRAEPDKTNDVLDVTKYNSMVDCCHKNYSTFTSEWYINERKYNDVPEGPKKAVVHRCTIL

SEQ ID NO: 242 - protein, 52 aa, African swine fever virus
MDDTLPKQMTPTDTSSSKEEQAHCNNKTLEKQPKNINDNKCTDSQNTESSKV

SEQ ID NO: 243 - protein, 356 aa, African swine fever virus
MQPSTLQALAKRALATQHVSKDDYYILERYGLWWHEAPISMYIDDDNQIMIRTLCFKEGIRLNTALVLAVKENNDDLIMLFTEWGANINYGLLFINNEHTRNLCRKLGAKEELETSEILRFFFETKCKITSSNVILCHELFSNNPFLQNVNMVDLRMIIYWELKDLTTNSMLNEISFSEMLTKYWYGIAVKYNLKEAIQYFCQEYRHFDEWRLICALSFNNVFDLHEICNTTKIHMSINKMMELACMRDNNFLTIYYCFALGANANRAMLISVKNFCIENMFFCMDLGANVIEHSKTLADIYGYSIIVNILSLKIYKANPILLSKETNPEKINTLLKNYYSKNMLAYDICCIDNYL

SEQ ID NO: 244 - protein, 42 aa, African swine fever virus
VANALLASACKVDGCMFILLKKIKLSGKHKDQPVVNICSSIF

SEQ ID NO: 245 - protein, 214 aa, African swine fever virus
MLGLQIFTLLSIPTLLYTYELELLDLTRTPPEKELEYWCTYANHCRFCWDCQDGICKNKVFENHSPILENDYIANCSVFRHNEFCTYYVTSIKPHEVYRTECPQHNHEWHEAVIRKWQKLLTYGFYLVGCVLVANYIRKRSLQTIIYLMVLLVIFFLLSQLMLYRELEAKKHKIGSIPPERELEHWCTHGKYCDFCWDCQNGICRNKVFKMIPP

SEQ ID NO: 246 - protein, 37 aa, African swine fever virus
MATCEQVAARQQIAVYQQIAVYQQQLIISKCCLWVSQ

SEQ ID NO: 247 - protein, 104 aa, African swine fever virus
MRFFSYLGLLLAGLASLQGFSTDNPLEEELRYWCQYVKNCRFCWACQDGLCKNKVLKDMPPVQEHSYPMEHCMIHRQCKYIRDGPIFQAECTMQTCDAIHLLNA

SEQ ID NO: 248 - protein, 124 aa, African swine fever virus
MLVIFLEILGLLANQVLGLPTQAGGHLRSTDNPPQEELGYWCTYMENCKFCWECAHGICKNKVNKSMPLIVENSYLTSCEVSRWYNQCTYGEGNGHYHVMDCSDPVPHNRPHQLLMKIYEKDDL

SEQ ID NO: 249 - protein, 51 aa, African swine fever virus
MYMVPHIKKNKRNYLILAVIFFQLATSQVTKELHCSFILRKRLNFGQKNHI

SEQ ID NO: 250 - protein, 124 aa, African swine fever virus
MLVVFLGILGLLANQVVGLPTQAGGHLRSTDNPPQEELGYWCTYMERCKFCWECAHGICKNKVNNSMPLIIENSYLTTCEVSRWYNQCTYGEGNGHYHVMDCSDPVPHNRPYQLLMKIYEKKDL

SEQ ID NO: 251 - protein, 205 aa, African swine fever virus
MLVIFLGILGLLASQVSSQLVGQLRPTEEPPEEELEYWCAYMESCQFCWDCQDGTCINKIDGSVIYKNEYVKSCLVSRWLDKCMYDLDKGIYHTMNCNQVLGLPNQPAGQLHPTDNPPQEELEYWCTYTENCKFCWNCQNGLCEGKLENTTILENEYVQSCIVSRWLNKCMYDLGQGIHHVMACSEPKPWNPYKILKREWKENNS

SEQ ID NO: 252 - protein, 137 aa, African swine fever virus
MLVIILGIIGLLASSNLVSSSTSTRVGGHLPLTFEPPENELGYWCTYVESCRFCWDCEDGICTSRVWGNNSTSIIENDYVKYCEVSRWGDLCRYDVEEHIYHSMNCSDPKPWNPYKIARKEWKKNEHPRKDLKKDEF

SEQ ID NO: 253 - protein, 127 aa, African swine fever virus
VATIKVLILVLLGVVVLQAAPIRKLEDLLPTRYPPEHELVYWCTYANQCDFCWECVHGICRNRIQTDWPVIHQNDWIINCTVSRWNGICSYYEGPKNHTDHQMDCANPTSHTYPHREYMKIYERDDL

SEQ ID NO: 254 - protein, 124 aa, African swine fever virus
MVRLFRNPIKCLFYRRSRKIQEKKLRKSLKKLNFYHPPEDCCQIYRLLENVPGGTYFITENMTNDLIMVVKDSVDKKIKSIKLYLHGSYIKIHQHYYINIYMYLMRYTQIYKYPLICFNKYYNI

SEQ ID NO: 255 - protein, 47 aa, African swine fever virus
MICNYKFVFFSYFATGNIKWWPVHLFNKKILTNLLLSLSLTYPVTIL

SEQ ID NO: 256 - protein, 290 aa, African swine fever virus
MKVIVFLLVLAVMQPVIQSQSFPGTGELPMTRRPPKRELEYWCTYAKSCDFCWNCRHGVCKNKVFEKHPLIKKNDYIQICRVSRYNERCSYFTDSRIRRFHIMSCTNPTYYDWFDELMQIKEDRVIDTENIKHTCLCMIATIALISYVRKQYSRMRMQAATRLLIFLGFYVLLGILMTNIIMNLPLSTDNPMQMRRPPERDLKFWCTYAKHCDFCWTCKDGMCKNKVFSDHPIITQNDYIVNCTVSRWHDRCMYEAHFRIHYQHNMNCSQPKDLEWFIELKRHVINQDDL

SEQ ID NO: 257 - protein, 63 aa, African swine fever virus
MAATYKLQLMGCNTATYRLHLIDRDSKGMKTLPSIQNLSFNPDNVSVYEKKFFLLMYEFLYES

SEQ ID NO: 258 - protein, 119 aa, African swine fever virus
MKLLALLCILIWLSQPGLNRPLSIFYMKQNLPRTYTPPIRELEYWCTYGKHCDFCWECRNGICKNKVWDDMPLIKQNDYISQCSIARYFDRCMYFIKPKSPYIHYMDCFQPTAYKGFSH

SEQ ID NO: 259 - protein, 116 aa, African swine fever virus
MKVLGLLLGYSVLILAHELPELPRTQHPPKEELPYWCTYVKNCDFCWDCQNGICKNKITNESNSMNSIVNCIVNRNSWGCFYEISVKMPNHHNMECSHPRPYTGNEIFMEKWGGGG

SEQ ID NO: 260 - protein, 119 aa, African swine fever virus
MKVFLGLLLGYSTILILTYQSPTTPWCFYEISLKIPNHHSMKCCSYPRLYEHEMFMEKWRDKNWPIIIRYYCFYLVFSFVFAGCVAFAICKNLRLSTTMKLLMLLSILVLLLSQPILNN

SEQ ID NO: 261 - protein, 274 aa, African swine fever virus
MKVLLGLLLGYSVLILAHELPDLPRTQHPPKSELSYWCTYVPQCDFCWDCQDGICKNKITESRFIDSNHSIVNCRVFRDSKTQSCLYEISSKMPNHFSMECLHPRPYTGNEIFMQTWGGGGGDHQQLSIKQYCLYFIIGIAYTGCFVCALCKNLRLSTTMKLFVLLSILVWLAQPVLNRPLSIFYTKQILPRTYTPPMRELEYWCTYGKHCDFCWDCKNGICKNKVLDDMPLIVQNDYISKCSITRFIDRCMYFIEPKIPYIHYMNCSLPTYFS

SEQ ID NO: 262 - protein, 387 aa, African swine fever virus
MNSLQVLTKKVLIETKAFSNYHEDDIFILQQLGLWWENGPIGFCKQCKMVTGGSMSCSDVDSYELDRALVKAVKENQTDLIKLFVLWGADINFGIMCAKTKQTKDLCIQLGANPEFLDVGLYNMFVYLVKRKKVLLAIEIYYDNILILDSFNSNDFHLLIDFVYNRFILYLDEKEEEMTRNTLVLKFWYKFAIDFNLTKPIHYLSKKFPHLDLWRLQTAIYLGNIDEVHHAYFQENIRLGLNVMMFLACARPGNKLGIYYCFALGADLDRALERLISFNSINREINRKIRGEKRLCIEGSYLSNVYFCIGLGANPYTKKIQEIIKQKHSNIMILLFSKKKILSPHSVLQNKILDPSDVHKMISTYKNTESFYPFSSLAVKLIQQANI

SEQ ID NO: 263 - protein, 42 aa, African swine fever virus
MFDLSSILIRGGGVLIALTLLWIIEYNEYFIDAKHFNSSSEA

SEQ ID NO: 264 - protein, 38 aa, African swine fever virus
MFIIHTNIMNFFCNIKLFLYHFRSIHKKNILKLFNFIE

SEQ ID NO: 265 - protein, 375 aa, African swine fever virus
MNSLQVLTKKVLIENKAFSNYHEDDIFILQQLGLWWENGPIGFCKQCKMVTSGSMSCSDVDSYELDRALVRAVKKNQTDLIKLFVLWGANINYGIICAKTERTKVLCIQLGADPKFLDVGLYNMFVDLIKQQKVLLAIDIYYDNISILDSFDSHDFYVLIDFIYNRFILNLDEKEKMIKNTYVLKFWFKIAIEFNLIKPIRFLSKKFPHLDYWRLKTAVYLGNVDEIHHAYFQENIRLDPNDMMSLACMYPQNKLGIYYCFALGANINTALETLIGFINHEVNREITFFSNYGIWSNVHFCISLGANPYTKKIQETLLRQEKNVMMKLLFKKGLLSPHSILHKKILEPSEVRKIISTYEYTETFHSFSSLRDNLR

SEQ ID NO: 266 - protein, 41 aa, African swine fever virus
MFNISSILIQGSVMILILLLWIINENFTDAGGNNFNHTVLM

SEQ ID NO: 267 - protein, 37 aa, African swine fever virus
MLKCLKIIVHQCCKFDQNLISHKKGTHQHCSFKFHDV

SEQ ID NO: 268 - protein, 44 aa, African swine fever virus
MFDSLLPTITGGGGGSLIALALLWFADYYVEFIEARLDSNITAV

SEQ ID NO: 269 - protein, 38 aa, African swine fever virus
MIKNRCIAQYSFGTSLEMIQATMITMYNSIVIFFFCNV

SEQ ID NO: 270 - protein, 69 aa, African swine fever virus
MLLYIVIIVACIISKLVPNEYWAIHLFFIIMIFMVYMYEKLDIHQKSQFWNYTMSGLSGHNVQVTCKCY

SEQ ID NO: 271 - protein, 268 aa, African swine fever virus
MVSLTTCCLKNIVNQHAYVENTVLLYHLGLRWNCKTLYQCTQCNGVNYTNSHSDQCKNKDLFLIKVIVKKNLAVARTLLSWGASPEYARLFCRNTEEEQALNVQHVADVPSSKILERLTMSYKGNDEQLLITFYLLNLSTNFSTNLREQVRFKIVSYIICDLAIHQTFKIFYAKNYSLSTLYCIFLAIYYKLYTALRKMVKIYPGLKSFAYLTGFMFDDETVMETYNSTDDEISECKNRIITIKGYYGNIHCRSDIDHMYAFSQNNFW

SEQ ID NO: 272 - protein, 330 aa, African swine fever virus
MQSLFNIALKALTLKNHVEFLKRDKEVLTRLGLCCKNYDLIHKCSECGNICPNGQQHGTCININYLLIYAVKRDNYMLAYRLLCWGANEKFAHYFRRPLPNLKPLLPKKELTPKDIKQLAYEHFHSDSELITVFEVFRKSRNINDCLEFFYKKNIEFEIYFARLYVYSKTFYRKSWYWFCIFMAVKHSMEHALKKITKTYIPTFYNKTTLPLVLFLSACFYENVEWMKNFFYKANKKIQQKMLSYGMEWAATHGKVRTFVCCYTLGGTASLKMYQKAYQNERYMIMALCSYLGNIQINNPWDSLNPYMMVQNKEKFLPLKFSEETQYFYI

SEQ ID NO: 273 - protein, 319 aa, African swine fever virus
MLSLQTLAKKAVAKQSVPEEYHYILKYCGLWWQNKPISLCHYCNYVILSSTPFKGELLHLDVALIMAIKENNYDVIRLFTEWGANIYYGLTCARTEQTQELCRKLGAKDSLNNKEIFTGLMRHKTSNNIILCHEIFDKNPMLEALNVQEMGEEIHRELKFFIFYILDNVPMNVFVKYCYAIAVKYKLKRAISFFYQTYGHLSMWRLMCAIYFNNVFDLHEIYEQKIVHMDIDKMMQLACMKDYNFLTIYYCFVLGGDIDQAITATQWHHQTNNLYFCKDLKDLKQNTLTARPLLLPNITDPKKIYTMLKNYLPTSSNSL

SEQ ID NO: 274 - protein, 350 aa, African swine fever virus
MVLSLQTLTKKVLASQYPAKCHPHFLKCCGLWWHNGPIMYHQKKIWTPYFKNGTNLNAALVKAVEENNHDLIELFTEWGANINYGLLSVNTEHTRDLCRQLGAKEQLNDQEILRFFYTLKRDLTSSNIIFCHEVFSNNPILDTINRFEVKGMIYEQLEGLMVETDILSEMFTKYWYAMAIECNLKEAICYFYQRYAHLHRWRLMCALFYNNVFELHEVYEKERIRIDMNEMLKWACRKNYNYLTIYYCCVVLGADINQAMFHSIQFYNIGNIFFCIDLGANAFEEGKTLAHQKDNSFIASMLSLNCYNMNDSLSLKETDPEVIKRMLKDYHSKNLSIAHKHYINDGFNDI

SEQ ID NO: 275 - protein, 345 aa, African swine fever virus
MFPSLQSFAKKVLARQQVSIEYHVILERCGLWWYKAPISLDCKHMLIKLPSFADGLDLNTALMLATKENNYQLIKLFTEWGADINYGLICANTPPVREFCWELGAKYRVDKKKIMHMFFKLIHPGTTSSNIILCLKLFNDNPFPAYVIIREIRSSIYWKLKRLVEDTDILSNMSDGDMLTIYCFIVALQDNLREAISYVYQHFKYLNTWWLICALCFNKLFDLHNLYEKEKIRMDVDEMMRMACTKDNNFLTIYYCFLLGANINSAMLACVRFYNMDNLFFCIDLGADAFEEAKALAEQRNYYLISHHLSLDIYSADSSLLTLKEADPNKIYHLLKNYKLKSMLA

SEQ ID NO: 276 - protein, 353 aa, African swine fever virus
MLPSLQSLTKKVLAGQCIPVDQYHVLKCCGLWWHNGPIMLHIRRNKLFIRSTCFSQGIELNIGLMKAVKENNHDLIKLFTEWGADINYGMICALTENTRDLCKELGAKEYLEREYILKIFFDTTRDKTSSNIIFCHEVFSNNPNLRIIDNLDLRGEIMWELRGLMEITFMLDHDDSFSTVLTKYWYAIAVDYDLKDAIRYFYQKYPRLHRWRLMCALFYNNVFDLHELYEIERVRMDIDEMMHIACIQDYSYSAIYYCFIMGANINQAMLVSIQNYNLGNLFFCIDLGADAFEEGKALAEQKENYLIAHALSLKHYNPVISLLSIVTDPEKINCMLKNYHSINMGIFLDYEQR

SEQ ID NO: 277 - protein, 531 aa, African swine fever virus
MFSLQNLCRKTLPNRKLPEFFDEYILQLLGLYWENHGTIQRAGNNCVLIQQHTLIPVNEALRTAASEENYEIVSLLLAWEGNLYYAIIGALEGNRHDLIRKYDDQIKDHHEILPFIDDPVIFHKCHIMRQCFFDCILYQAVKYSKFRVLLYFKHRLEDDLPFTHLLIEKACKDHNYEVIKWIYENLHIYNMIDTFECAIAHKDLHLYCLGYRFIYNRIVPDKYHHLDIRMLSSLQLLHKVAAKGYLDFILETLKYDHNKDNINIILTQAATYNHRKILIYFIPQSTHAQIEQCLLVAIKAKSSRKTLNLLLSHLNLSINLIKKISHYVATYNSTNIIGILSMRRKKKIYLDIILTKFVKKAIFNKFVVRCMDTFSINPERILKIAARINRMMLVKKISEHVWKNHAVRLKYLKHAVHTMKHKDGKNRLMNFIYDRCYYHMQGEEIFSLARFYAIHHAPKLFDVFYDCCILDTIRFKSLLLDCSHIIGKNAHDATNINIVNKYIGNLFVMGVLSKKEILQDYPSIYSKQYMP

SEQ ID NO: 278 - protein, 350 aa, African swine fever virus
MLPSLQSLTKKVLAGQCVPTNQHYLLKCYDLWWHDAPITFDHNLRLIKSAGIKEGLNLNTALVKAVRENNYNLIKLFAEWGADINYGLVSVNTEHTWDLCRELGAKETLNEEEILQIFIDLKFHKTSSNIILCHEVFSNNPILQKVNNIKMRIEIFWELRELIVKTDLLNNEFSLSTLLLKYWYAIAIRYNLKEAIQYFYQKYTHLNTWRLTCALCFNNVFDLHEAYEKDKIHMDIEEMMRIACIKDHNLSTMYYCYVLGANINQAMLSSIQYYNIENMFFCIDLGADVFEEGTTALGEGYELIKNILSLKIYSPATTPLPKSTDPEIIDHALKNYVSKNMMIFLTYDLR

SEQ ID NO: 279 - protein, 353 aa, African swine fever virus
MSLPLSLQTLVKKTIASQCLSIDEHCILKYCGLWWHDAPLKLCMDRGRIQIKSGFLGEDIDLRVALIIAVKENNYSLIKLFTEWGANINYGLLSINTKHIRELCRQLGAKETLEDNDIFRIFTRIMHNKTSGSIILCHEIFMNNPILENKFVIQLRGLIYKRLWGLIEIKETDELNGLLVKYWYAKAVQYDCKDAICFLDEKYTDLNEWRLKCLLYYNKIYELHEMYHKENIQIDVHDMICLASTKDNNPLTIYYCYALGGNINQAMLTSVQYYNIGNIFFCIDLGGNAFEEGRAIAEQKGYNFLSHSLALDIYSSDASLPLNLKDPEEISSLLKDYKSKNLSIIWEYSHNIL

SEQ ID NO: 280 - protein, 357 aa, African swine fever virus
MLSLQTLAKKVVACNYLSSDYDYTLQRFGLWWDLGPIHLCNNCKQVFSYKHLQCFSEDDLCLEAALVKAVKSDNLELIRLFVDWGANPEYGLIRVPAVYLKRLCAELGGLTPVSEPRLLEILKEVARLKSCAGVLLGYDMFCHNPLLETVTRTTLDTVTYTCSNIPLTGDTAHHLLTKFWFALALRHNFTKAIHYFYKRHKNHLYWRVACSLYFNNIFDIHELCREKEICISPNLMMKFACLREKNYAAIYYCHRLGASLDYGMNLSIYNNNTLNMFFCIDLGAADFDRAQLIAHKAYMYNLSNIFLVKQLFSRDVTLVLDVTEPQEIYDMLKTYTSKNLKRAEEYLTAHPEIIVID

SEQ ID NO: 281 - protein, 526 aa, African swine fever virus
MFSLQDLCRKHLFILPDVFGEHVLQRLGLYWRCHGSLQRIGDDHILIRRDLILSTNEALRMAGEEGNNEVVKLLLLWKGNLHYAVIGALQGDQYDLIHKYENQIGDFHFILPLIQDANTFEKCHALERFCGVSCLLKHATKYNMLPILQKYQEELSMRAYLHETLFELACLWQRYDVLKWIEQTIHVYDLKIMFNIAISKRDLTMYSLGYIFLFDRGNTEATLLTQHLKKTAAKGLLHFVLETLKYGGNIDTVLTQAVKYNHRKLLDYFLRQLPRKHIEKLLLLAVQEKASKKTLNLLLSHLNYSVKRIKKLPRYVIEYESTLVIKILLKKRVNLIDAMLEKMVRYFSATKVRTIMDELSISPERVIKMAIQKMRTDIVIHTSYVWEDDLERLTRLKNMVYTIKYEHGKKMLIKVMHGIYKNLLYGEREKVMFYLAKLYVAQNAATQFRDICKDCYKLDVARFKPRFKQLILDCLEIITKKSCYSILEILEKHIISLFTMKVMTEEEKNLCLEILYKVIHYKTIQC

SEQ ID NO: 282 - protein, 280 aa, African swine fever virus
MSSSLQELCRKKLPDCILPEFFDDYVLQLLGLHWQDHGSLQRIEKNQILVQQEPIHINEALKVAASEGNYEIVELLLSWEADPRYAVVGALESKYYDLVYKYYDQVKDCHDILPLIQNPETFERCHELNSTCSLKCLFKHAVINDMLPILQKYTDYLDRWEYCSQMLFELACSKKKYEMVVWIEGVLGVGKVTSLFTIAISNRDLQLYSLGYSIILENLYSCGQDPKFLLNHFLRDVSIKGLLPFVIKTIEYGGSKEIAITLAKKYQHKHILKYFETWES

SEQ ID NO: 283 - protein, 40 aa, African swine fever virus
MFPTDVLKRKHLFTKKNINFTGILMYDKTVVHWFEISKTI

SEQ ID NO: 284 - protein, 506 aa, African swine fever virus
MFSLQDICRKHLFQLPDAFDEYILQALGLYWEKHGSLQRIRKDAVFVQRNIVLSTNEALRIAASEGNERVIKLLLSWEGNFHYVIIGALEGDQYDLIHKYDSQIKDYHMILSLIQNANTFEKCHQLSNSNMWCLIQNAIKYNMLPILQKHRNILTHEGENQELFEMACEEQKYDIVLWIGQTLMLNEPEFIFDIAFERIDFSLLTMGYSLLFDNKMSSIDIHDEEDLTSLPTEHLEKAATKGCFFFMLETLKHGGNVNMAVLSKAVEYNHRKILDHFIRRQKCLSREEIENLLLTAITNCASIKTLNLLLSYLNYSVKNIIGKIVQHVIKDGDYTIILLLKKKKINLVEPVLTGFIDYYYSYCFIKHFIQEFAIRPEKLIKMAARKGKLNMIIEFLNEKYVHKDDLGTIFKYLKTLVCTMKHKKGKETLIVLIHKIYQDIHLETKEKFKLLRFYVMHDATIQFLSMCKDCFNLAGFKPFVLECLDIAIKKNYPDMIQYIEILSKSE

SEQ ID NO: 285 - protein, 498 aa, African swine fever virus
MFSLQEICRKNIYFLPDWLGEHVIQRLGLYWEKHGSLQRIGDNYVLIQQDLIIPINEALRMAGEEGNDEVVQLLLLWEGNIHYAIIGALESDHYSLIRKLYDQIEDCHDILPLIQDPKLFEKCHELDKSCNILCLVLHAVKNDMLCILQEYKMHLSGEDIQVVFETACRSQKNDIVSWMGQNIAIYNPEVIFDIAFDKMNVSLLSIGYTLLFNHHINNTNENINSLLTQHLEWAAGMGLLHFMLETLKYGGDVTIIVLSEAVKYDHRKILDYFLRRKNLYQEDLEELLLLAIRADCSKKTLNLLLSYLNYSINNIRKKILQCVKEYETTVIIKILRKRKINLIEPILADFIGYHSYTYMVDFMREFSIHPEKMIKMAARESREDLIIKFSKKVCKEPKDRLHYLKSLVYTMRHKEGKQLLIYTIHNLYKACHLESKEMFNLARFYARHNAVIQFKSICHDLSKLNINIKNLLLECLGIAIKKNYFQLIKTIETDMRYE

SEQ ID NO: 286 - protein, 525 aa, African swine fever virus
MFSLQDLCRKNIFFLPNDFSKHTLQWLGLYWKEHGSVHRAEKDSIMIQNELVLSINDALQLAGEEGDTDVVQLLLLWEGNLHYAIIGALKTEKYNLICEYHSQIQDWHILLPMIQDPETFEKCHDLSLGCDFICLLQHAVKYNMLSILVKYKEDLLNARIRHRIQSLFVLACENRRIEIIDWIGQNLPIPEPDAIFSIAVATRDLELFSLGYKIIFDYMQRQGIIQLTNGVRMVVLNRHISMAIDNGLLPFVLETLKHGGNIHRALSYAVTHNRRKILDYLIRQKNIAPNTIERLLYLAVKNQSSRKTLNLLLSYINYKVKNVKKLVEHVVNEKSTLVLKILLEKKENLVDAVLTRLVKHSTYFQVREFIQEFSISPEKFIKIAVREKKNVLIEAISEDIWENPTERITYLKQIVHTIKYESGRRFLVDIIHSIYQSYSLKHEDILKLATFYVKHNAITHFKDLCKYLWLNRGTESKKLFLECLEIADEKEFPDIKSIVSEYINYLFTAGAITKEEIMQAYDALE

SEQ ID NO: 287 - protein, 527 aa, African swine fever virus
MFSLQDLCRKNTFFLPSDFSKHTLHLLGLYWKGHGSIQRIKNDGVLIEHDLTLSINEALILAGEEGNNEVVKLLLLWEGNLHYAIIGALRTENYNLVCEYHSQIQDWHVLLPLIQDPETFEKCHDLSLECDLSCLLQHAVKYNMLSILVKYKEDLLNVLFRQQIQGLFILACENRKLEILTWMGQNLPIPDPEPIFSIAVVTKDLEMFSLGYKIVFEYMENQGLHLTQVVRMVMLNHHFGMVINKGLLPFVLEILNYGGNVNRALSYAVTQNKRKILDHVVRQKNIPHKTIERMLHLAVKKHAPRKTLNLLLSYINYKVKNVKKLLEHVVKYNSTLVIRLLLEKKKNLLDATLTRYVKDSTYFQVKEFMQDFSISPEKFIKIAVREKRNVLIKGISEDIWENPAERIRNLKQIVCTIKYESGRQFLINIIHTIYQSYSLKPEEILKLATFYVKHNATTHFKDLCKYLWLNRRTESKKLFLECLEIADKKEFPDIKSIVSEYINYLFTAGAITKEEIMQAYALEYAMY

SEQ ID NO: 288 - protein, 506 aa, African swine fever virus
MFSLQDLCRKNLFLPLEPLGKHVVQRLGLYWEGHGSVKRVGDCFICVDQIWMLSIHKAIQIAASEGNENIVKLFLLWKGSLQYAIIGALEGRQYDLIQKYYNQIGDCHQILPLIQDPEIYERCHELNVTCTFQCLFQHAIRDNMLPIFQKYGEDLNGNRRMVQLLYEMACRLQNYDIIKWIGSNLHVYNLEAIFSIAFVRKDLTLYSLGYMLLLGRMSTEDRNFISIITRHLEYASKKGLFDFVLESLKYGGQVDTVLFQAVKYNHRKILAHFIHEIPRETVEKLILHAVESRASRKTFNLLLSSINYCVNPFVKKLLHAVVKHKYMLIIKLLLERPKKKINLVDAALFKLVKYSTYTEIVKYMGEFSVDPKRVVKMAARLMRVDLIKKISNDAWEDKLERIKHLKQMVNTMNHRNGKNLLMYNIHNITGYTYLNTKEAFNLTRFYAVHNATCLFKEMCKSCFVHDKIQLRELLEDCLHIANRHDYIQIAETADECIKYIDLITFK

SEQ ID NO: 289 - protein, 542 aa, African swine fever virus
MFSLQELCRKNIYILPYPLAKHVLQQLGLYWKGHGSLQRIGDDHVLLQQDLIFSINEALRMAGEEGNNEVVKLLLLWEGNLHYAIIGALEGDRYDLIHKYYDQIGDCHKILPLIQDPQIFEKCHELSNSCNIRCLLEHAVKHDMLSILQKHKEQIRLHMALTQILFELACHERKNDIIRWIGYSLHIHHLETIFDVAFAHKNLSLYVLGYELLMHKVNTEAAYIELPNLLSYHLRTAAAGGLLNFMLETIKHGGYLDKTVLSAAIRYKHRKIVAHFIHQVPRKTVKKLLLYAVQARAPKKTLNLLLSSLNYSVHTITKQLVHNVVIYSSTLIVKLLLMRRKNKLNLVDAVLARLVKYSTYTDIVQFMGEFSVSPERVIKMAARESRTFLIEMISKAAWGNHPQTLIHHLKQLTNTMKPQSGKDHIIYTIHYIYLNSNMLVAEEEKNIFKLAKFYANHNAVNRFKQICEDYYILDARFKTLILECFEIAVQKNYPRIANIVDDYIRFLFYRGNITEEEIREAYSLKDAEVYVDLKWLQQGEMV

SEQ ID NO: 290 - protein, 224 aa, African swine fever virus
MFPKINTIDPYISLRLFEVKPKYVGYSSIDARNQSFAIHDIKNYEKFSNAGLFYTSPTEITCYCCGMKFCNWLYEKHPLQVHAFWSRNCGFMRATLGIIGLKKMIDSYNDYYNNEVFVKHQNRVYTHKRLEDMGFSKPFMRFILANAFIPPYRKYIHKIILNERYFTFKFAAHLLSFHKVNLDNQTTYCMTCGIEPIKKDENFCNACKTLNYKHYKTLNFSVKL

SEQ ID NO: 291 - protein, 50 aa, African swine fever virus
MSGFMNSLRKCIGNINSHLEGFMRTYLLRIIRKIKPTTQPSIEDDHYKCL

SEQ ID NO: 292 - protein, 104 aa, African swine fever virus
MSTKKKPTITKQELYSLVAADTQLNKALIERIFTSQQKIIQNALKHNQEVIIPPGIKFTVVTVKAKPARQGHNPATGEPIQIKAKPEHKAVKIRALKPVHDMLN

SEQ ID NO: 293 - protein, 236 aa, African swine fever virus
MRGILIAIEGINGVGKSTQAMKLKETLECMDYNAICIHFPNPDTTTGDLILQVLNKTIEMSSEQLHKLFTKHRSEFIAEIAVLLKLNYIVIVDRYIWSGLVYAQADGITIETKNTFKPDYTFFLSSKKPLNEKPLTLQRLFETKEKQETIFTNFTIIMDDVPKNRFCIIPATLNKEIIHMIILTKTLKVFDNNSCLNYIKMYDDKYLNVQDLNLFDFDWQKYIEDNNDKEEYDFIV

SEQ ID NO: 294 - protein, 60 aa, African swine fever virus
MHSNVSFNFIACVLFPTPLIPSMAMSIPRMINKRKKRIQFLTFLTNLFLYNIVQHCISGI

SEQ ID NO: 295 - protein, 158 aa, African swine fever virus
MNKKIIVMMALLHKEKLIECIYHELENGGTILLLTKNIVVSEISYIGNTYKYFTFNDNHDLISKEDLKGATSKNIAKMIYNWIIKNPQNNKIWSGEPRTQIYFENDLYHTNYNHKCIKDFWNVSTSVGPHIFNDRSIWCTKCTSFYPFTNIMSPNIFQ

SEQ ID NO: 296 - protein, 289 aa, African swine fever virus
MNKIFLNITETINMVLIEFLTGFFYLYGKRLFSISKVMDMICLDYYTIIPAPLAMMLAARLKNYDLMKRLHEWEISIDYALLVVDDVPSIDYCLSLGARSPTRAQKRELLRDNTFNPVYKYLMNCSGFPTKREKNIPCDVQCERLQKNIIKELVFNCSVLLEMVLHTEREYAYALHCAAKHNQLPILMYCWQQSTDAESILLKTCCSDKNINCFNYCILYGGAQNLDAAMVEAAKHDARMLINYCVMLGGRSLNEAKETAAMFGHIECAQHCFKLQSYVVDTSNTDDTD

SEQ ID NO: 297 - protein, 226 aa, African swine fever virus
MFPEREIENLFVKWIKKHIRNGNLTLFEEFFKTDPWIVNRCDKNGSSVFMWICIYGRIDFLKFLFEQESYPGEIINPHRRDKDGNSALHYLAEKKNHLILEGVLGYFGKNGTRICLPNFNGMTPVMKAAIRGRSLNMLSLIKFGADPTQKDYHRGFTAWDWAVFTGNMELVKSLNHDYQNLSTCISLFTSWMFSTGGLRKSPKLLLLAVNIMSMKNFLNRIQSSCV

SEQ ID NO: 298 - protein, 858 aa, African swine fever virus
MCAGFYVAVHPWLEAQSLHKVGHTGNLAARLHDGSYTTCFTDEWKYCFTLETSTKKDAQKIEAGVLYCAQFFRVKNKELVCLLPEKIKQLAEDVANCLDISYTLCDSPAYEMNDSTIVVEPSLPSDPLISKEKLRHLVITPVEDEHFADDVLFFSTDETRTAIEDRLYQKEAANMGYQELRRSGRAILQMACRCGKTRVAYLILSNYLQGKVLYLVPGLSLLRQTLEKLYQYGISLKNVLLVGSDQTRIVLNHDNIEMTTNPVFIAKRIREAPSLLVIATYQSSTLLVDDFDLIISDECHRICGEWETRPFTHVLLNFKKGHRLFLTATPRYDTPLSMKNRELFGGVAFRYYLREGIEAGYVNDFELQMVAAPKLAHQPSTKEETTKQIIVKQIIMALAYLKTNIPAPKMLVFTRDIKQAKELYAALVDQGVYALIAHSTLPRQVILKTFTEFCSSKEPVILLNCRLFQEGVEVPELNAVFFAAPRHSPRDIIQSICRPLNKQVQKPHATIFLPLEVNTENVCLDRFSSIIPFADALASEDPRFYEHLLNPSEVAYPINWIGAHGSVSELLQLARHAIRYGTQGKIDRLTRSERLPWKAAFAELKRTVEICCRYPKINDGFHFGGATLRFDTWYKWVIKSYLQYKNKEPSSLEPYQVSDLESLQDWTTRGVGGPYPWEESMAFLETWLAQNKGELVAIDIHQGGWIGLDATPMERLSGVLTTVSQRDGRSYGKNKKLRPKKGFMIPPQQAQDLDRIFGKHNLKWRKDRVNGFLKEDEHGNYTGEPTCIQEAYRTFKEYVKTNPEYIEKYWPGYAKGKHKHQELPHIWEKGLAPPRYKAFKDGNKQLIQRSPKKKDIKN

SEQ ID NO: 299 - protein, 179 aa, African swine fever virus
MEGEELIYHNIINEILVGYIKYYINDISEHELSPYQQQIKKILTYYDECLNKQVTITFSLTSVQEIKTQFTGVVTELFKDLINWGRICGFIVFSAKMAKYCKDANNHLESTVITTAYNFMKHNLLPWMISHGGQEEFLAFSLHSDMYSVIFNIKYFLSKFCNHMFFRSCVQLLRNCNLI

SEQ ID NO: 300 - protein, 137 aa, African swine fever virus
MEAVLTKLDQEEKKALQNFHRCAWEETKNIINDFLEIPEERCTYKFNSYTKKMELLFTPEFHTAWHEVPECREFILNFLRLISGHRVVLKGPTFVFTKEIKNLGIPSTINVDFQANIENMDDLQKGNLIGKMNIKEG

SEQ ID NO: 301 - protein, 317 aa, African swine fever virus
MVETQMDKLGFLLNHIGKQVTTKVLSNAHITQTMKEIILENHSVDGGAAKNVSKGKSSPKEKKHWTEFESWEQLSKSKRSFKEYWAERNEIVNTLLLNWDNVRGAIKKFLDDDREWCGRINMINGVPEIVEIIPSPYRAGENIYFGSEAMMPADIYSRVANKPAMFVFHTHPNLGSCCGGMPSICDISTTLRYLLMGWTAGHLIISSNQVGMLTVDKRIIVDLWANENPRWLMAQKILDIFMMLTSRRSLVNPWTLRDLKKILQDYGIEYIIFPSNDFFIYEDERLLMFSKKWTNFFTLHELLDDLETIETKASSTT

SEQ ID NO: 302 - protein, 334 aa, African swine fever virus
MLIFISNMEELLIENSQRFTIFPIQHPECWNWYKKLESLTWTAQEVDMCKDIDDWEAMPKPQREFYKQILAFFVVADEIVIENLLTNFMREIKVKEVLYFYTMQAAQECVHSEAYSIQVKTLIPDEKEQQRIFSGIEKHPIIKKMAQWVRQWMDPDRNTLGERLVGFAAVEGILFQNHFVAIQFLKEQNIMPGLVSYNEFISRDEGMHCSFACFLISNYVYNIPEEKIIHKILKEAVELVDEFINYAFDKARGRVPGFSKEMLFQYIRYFTDNLCFMMQCKSIYKVGNPFPQMTKFFLNEVEKTNFFELRPTQYQNCVKDDAFAFKLFLNDDDF

SEQ ID NO: 303 - protein, 778 aa, African swine fever virus
METFFIETLASDVYGKALNVDLDRLSQAQVKYTLQELISYCSALTILHYDYSTLAARLSVYQLHQSTASSFSKAVRLQAAQSCSRLSPQFVDVVYKYKAIFDSYIDYSRDYKLSLLGIETMKNSYLLKNKDGVIMERPQDAYMRVAIMIYGMGRVVNMKMILLTYDLLSQHVITHASPTMFNAGTKKPQLSSCFLLNVNDNLENLYDMVKTAGIISGGGGGIGLCLSGIRAKNSFISGSGLKSNGIQNYIVLQNASQCYANQGGLRPGAYAVYLELWHQDIFTFLQMPRLKGQMAEQRLNAPNLKYGLWVPDLFMEILEDQIHNRGDGKWYLFSPDQAPNLHKVFDLERSQHENAHREFKKLYYQYVAEKRYTGVTTAKEIIKEWFKTVVQVGNPYIGFKDAINRKSNLSHVGTITNSNLCIEVTIPCWEGDKAEQGVCNLAAVNLAAFIRENGYDYRGLIEASGNVTENLDNIIDNGYYPTEATRRSNMRHRPIGIGVFGLADVFASLKMKFGSPEAIAMDEAIHAALYYGAMRRSIELAKEKGSHPSFPGSAASKGLLQPDLWVRCGDLVSSWEERVAQTTQGVLTPKRWSQLRLAAMQGLRNGYVTALMPTATSSNSTGKNECFEPFTSNLYTRRTLSGEFIVLNKYLIDDLKEINLWTEAIQQQLLNAGGSIQHILDIPAEIRDRYKTSREMNQKILTKHAAARNPFVSQSMSLNYYFYEPELSQVLTVLVLGWKKGLTTGSYYCHFSPGAGTQKKIIRNSEKACNADCEACLL

SEQ ID NO: 304 - protein, 165 aa, African swine fever virus
MVNPNKRIMNKKSKQASISSILNFFFFYIMEYFVAVDNETSLGVFTSIEQCEETMKQYPGLHYVVFKYMCPADAENTDVVYLIPSLTLHTPMFVDHCPNRTKQARHVLKKINLVFEEESIENWKVSVNTVFPHVHNRLSAPKLSIDEANEAVEKFLIQAGRLMSL

SEQ ID NO: 305 - protein, 1048 aa, African swine fever virus
MQETFKFLRCNSQGEAVEDKYSLETLKNHFVVRDEYNNLFRVFSSRDDFWEWEAAQPFEQKCFHEVVFGFLPQRLKFDIDFPVNKSYSDDNVDDNDNVEDNVYDILDMIINVIMDVFYETYSLPYNINLTREQILLTDSIGLNKKRELKYSFHIILYTYSVLNNNEAKVFTSKVLENLPKHVYPFVDPQVNKSIQNFRIIGSHKKGSMRVKMFNEELAEVFETSTTTKKSDTLIATPFETTCLPCIFTNVKETTPSSCDTIQQSELEEVLKFAGTLCKNHCFLRVHKNLVLFKRTSPSYCEICKRMHDKDNTLILRVTGNKVYQHCRHDNKHSLLMGSLSGTNNFVETYVDQVMTKSIEVHESILFEELPDTQKHIYDESSMREYERVPTLVVKAQMKIGKTVQLRNYLQKYYGNNSISKQQTIRFVTFRQIFSKNIQSRLPNFTLYSEVTGDLDSYERVIIQVESLFRLTSTAEPVDLLILDEVESIFNQFNSGLHKYFAPSFAIFMWMLETANYVICLDANLGNRTYNILQRFRGDVPIFFHWNQYKRAQHDTYYFTSSRETWLNNLLKDLLEDKKIVIPTNSLMEARLLQSFIQKKFPEKKIGFYSSKSTAHERESHFNNVSYYWGLVDILIYTPTISAGVSYEDKRFDVLYGFFNNMSCDVETCCQMLGRVRELKSKCYKICLQGKQNYYPETIEDIEMFTLQKRDTLFQTISNHQLSFTYSKETGRPIYYKTPYYHLWLETMRIQHLSKNHFITRFINQIADTGAKVFILTGEKLETVKQYTSIKMEIKHQDYVNIASAETIDANKALQIKQNLKEGITVDQQDLFAYEKYKLLEFYAWHGHKITPKFVEQYNSFMTKQNYTGRVQISRGKTVYESLTMLQTQELNFHQWAMQHAEHHDLQFNYSFQSHMYAIMLLTKCGFKCVQDPNILTNEQLMTKLVDEFVQYDLSAISFEFKLKKPNKTDPQTILKFINKVLGLRYGLKIHHNKGNYYIKNTKAGSLIPFVRQQIKQSPCVVSNLLPITETSSAKEETSPIKEETFTET

SEQ ID NO: 306 - protein, 205 aa, African swine fever virus
MVEPREQFFQDLLSAVDQQMDTVKNDIKDIMKEKTSFMVSFENFIERYDTMEKNIQDLQNKYEEMAANLMTVMTDTKIQLGAIIAQLEILMINGTPLPAKKTTIKEAMPLPSSNTNNEQTSPPASGKTSETPKKNPTNAMFFTRSEWASSNTFREKFLTPEIQAILDEQFANKTGIERLHAEGLYMWRTQFSDEQKKMVKEMMKK

SEQ ID NO: 307 - protein, 78 aa, African swine fever virus
MPTKAGTKSTANKKTTKGSSKSGSSRGHTGKTHASSSMHSGMLYKDMVNIARSRGIPIYQNGSRLTKSELEKKIKRSK

SEQ ID NO: 308 - protein, 196 aa, African swine fever virus
MNIIRKLKPGTISLVLGPMFAGKTTFLIHCIYMLERLEKKVVFIKSTKNTRDKTIKTHSGIQLRPKQCKIIESTQLSDVGSLTDIHAVVVDEAHFFDDLITCRTWAEEEKIIILAGLNASFEQKMFPPIVRIFPYCSWVKYIGRTCMKCNQHNACFNVRKNADKTLILAGGSELYVTCCNNCLKNTFIKQLQPIKY

SEQ ID NO: 309 - protein, 145 aa, African swine fever virus
MDHYLKKLQDIYTKLEGHPFLFSPSKTNEKEFITLLNQALASTQLYRSIQQLFLTMYKLDPIGFINYIKTSKQEYLCLLINPKLVTKFLKITSFKIYINFRLKTFYISPNKYNNFYTAPSEEKTNHLLKEEKTWAKIVEEGGEES

SEQ ID NO: 310 - protein, 422 aa, African swine fever virus
MYTHVDVVGIAEASAALYVQKDRDRYLDVLTTIENFIYQHKCIITGESAHLLFLKKNIYLYEFYSNNVAEHSKALATLLYKLDPEYLTRYTVLITKIPNHWYVINVDQREFVRLYAIPAVKQHLPIPILPFYCTSALTQQELFCLGPELQLIQIYSKLCNPNFVEEWPTLLDYEKSMRMLFLEQFPQRLEMTGGKKEEKEKHESIIKKIILEMVSTRQRIVVGGYIQKNLYNHVLKNRNRLQLITSLNIYEEKDIIQQFCDSNGLKIKIRINNPLLPTNPELRRLTIYFNHNNDDDQSYLIVDMYNTGSYELVPTNQINTLDGSFLIGTPFVQARFLLVEIWVLMLIAQQTKKDTKKIIQFFINQYEMLMNSPWPSMEALFPSSSKRYLGNYVDPNALIKWAQLKLKRIPPFYPGKPDEESC

SEQ ID NO: 311 - protein, 1242 aa, African swine fever virus
MEPLRPQITYGPIETVDNEELTEADMLSFISAAVNSTGLIGYNIKSFDDLMDNGIPQIVKQMFNVDITYKDQRDHTEIDKLRESVQIQFNFTDVNIERPQHRNYSQGNKINLLPNKARLCGLSYSGPVNLAAEVILTAHYSNGRQEVKRASIPPFQVSTFPIMRGSNRCHTHHLSKTAKKEIGEDPNEPGGYFIARGGEWVVDLLENIRFNTLHIHYHTMQQGNNEIIRGEFISQPGGAFENSSQIIIRYMTTGAITIEINSTKFSKLRIPWYLIFRMFGMTGDDSIIEQVVFDLESNSLVNTFMIEILEKSIHVLDPIFQPVQHELNREKIIQFLSEKVSKFVSNPSAYKSDENAVQYLNERQLTILDKILLPHMGQTADTRVRKLRFLGLLIHKILLVIMNVFPPTDRDSYRTKRVHGSGVSLAKAFKAIFNTSVIAPIINGFKELLKQTAFEELTQRNIIEAFSAALSKNTASDLNRSMEQSIISGNKTIMVRQRPIVNRVSTQSLERKNLLNTISALRTVNTHNTTNASKQTERADMMRRVHASYPGYICVAQSADTGEKVGMSKQLAITANVCTAGEVLSLKQRLLSDPAIQQLADVSNKDIVRKGLARVFINGEWIGCCTNAFELAQRYRMLRREGKVVHPHTTIYWDSMVDEVEFWLDVGRLTRPLLIVDNNIEKYNQACYKAAEARKKGDKDWEKHKIPFIQNTRFTPQMAKDILAGTLTLEDLVAQGICEFITPEEAENCLVAFSIIELRKHKHDVTRRFTHVDVPQAILGLAALVSPYANCTQPARVTYETNQGRQTGGWYCFSWPYRVDMNRFFQFYNEMPLVKTIAHNYVIPNGLNTIVAYMIYGGYNQEDSVIVSQSFIDRGGFAGTFYREEKVELESDIESFGKPDPLITKNLKPGANYEKLVDGFVPVGTVVKKGDIIIGKVAKIRGEKDELNKYIDRSVMYGFDEPAVVDAVMRPHGPNDEIFGLMRLRYERNLNIGDKMSSRSGNKGIAALALPTSDMPFTEDGLQPDLIVNPHSHPSRMTNGQMIETTVGLANALQGVVTDGTAFLPINVQLLSERLAQEGLRFNGCQKMFNGQTGEYFDAAIFIGPTYHQRLQKFVLDDRYAVASYGPTDALTGQPLDGKRSHGGLRLGEMEHWVLTAQGAMQTIIEKSHDDSDGCISYICRNCGEPAIYNASHPIYKCMNCDVQADIGMVDSRRSSIVFQHEMRAANVNITSVLSPRVFQPA

SEQ ID NO: 312 - protein, 84 aa, African swine fever virus
MPYARDITKFITATEPEVGLPLLALQRSKSIIGVILLVISLLFIFIGIIILSVSSGHTTAASIFIVLSLILGGGGFFLIYKDNS

SEQ ID NO: 313 - protein, 418 aa, African swine fever virus
MSNYYYYYGGGRYDWLKTVEPTNFLKIGLPYQAHPLHLQHQATTPPSILEKFKRADILLNEVKAEMDPLMLQPETEKKLFQILSSIDMFKGLRKKVEFTYNAQIVTNAWLKMYELLNTMNFNNTSQAFCNCELPGGFISAINHFNYTMMHYPTFNWVASSLYPSSETDALEDHYGLYQCNPDNWLMQSPLLKKNIDYNNGDVTIASNVKNLALRATQRLTPIHLYTADGGINVGHDYNKQEELNLKLHFGQALTGLLSLSKGGNMILKHYTLNHAFTLSLICVFSHFFEELYITKPTSSRPTNSETYIVGKNRLRLFTPKEEQVLLKRLEFFNDTPLVDLSLYQNLLESVYFAVETIHLKQQIEFLNFGMKCYRHFYNKIKLLNDYLAPKKKIFQDRWRVLNKLYVLEKKHKLKLCAS

SEQ ID NO: 314 - protein, 152 aa, African swine fever virus
MYSILIACLVLLLCLVIYVGHRADHARKYLEGMWHGDPVFLKQSGLQSFYLYIQPDHTCFFSIVNKNGEKLMETKIPCTITNKIYMFFKPIFEFHVVMEDIHSYFPKQFNFLLDSTEGKLILENNHVIYAVLYKDNFATALGKTVEKYITQN

SEQ ID NO: 315 - protein, 158 aa, African swine fever virus
MFSNKKYIGLINKKEGLKKKIDDYSILIIGILIGTNILSLIINIIGEINKPICYQNDDKIFYCPKDWVGYNNVCYYFGNEEKNYNNASNYCKQLNSTLTNNNTILVNLTKTLNLTKTYNHESNYWVNYSLIKNESVLLRDSGYYKKQKHVSLLYICSK

SEQ ID NO: 316 - protein, 360 aa, African swine fever virus
MIILIFLIFSNIVLSIDYWVSFNKTIILDSNITNDNNDINGVSWNFFNNSFNTLATCGKAGNFCECSNYSTSIYNITNNCSLTIFPHNDVFDTTYQVVWNQIINYTIKLLTPATPPNITYNCTNFLITCKKNNGTNTNIYLNINDTFVKYTNESILEYNWNNSNINNFTATCIINNTISTSNETTLINCTYLTLSSNYFYTFFKLYYIPLSIIIGITISILLISIITFLSLRKRKKHVEEIESPPPESNEEEQCQHDDTTSIHEPSPREPLLPKPYSRYQYNTPIYYMRPSTQPLNPFPLPKPCPPPKPCPPPKPCPPPKPCPSAESYSPPKPLPSIPLLPNIPPLSTQNISLIHVDRII

SEQ ID NO: 317 - protein, 369 aa, African swine fever virus
MYFLVADHREHHVIPFLKTDFHHMHQNPIQKNQALLEIKQLFTGDYLICKSPSTILACIERKTYKDFAASLKDGRYKNRQKMLSLREQTNCQLYFFVEGPAFPNPQKKINHVAYASIITAMTHLMVRDHIFVIQTKNEAHSSQKLVQLFYAFSKEMVCVVPTSLTPTDEELCIKLWSSLSGISGVIGKILANTCSVAHLVHGKLSSQNIDQLKTPSNRPFPKKVKRMLISISKGNKELEIKLLSGVPNIGKKLAAEILKDHALLFFLNQPVECLANIQIVQKTRTIKLGMKRAEAIHYFLNWCGSAHVTDDSQNITEASRSTMQVATQSAAIQPAATQPLHEVSDDASSDASSPVGYQTLSKEMLLNTA

SEQ ID NO: 318 - protein, 1249 aa, African swine fever virus
MEEVITIAQIVHRGTDILSLNNEEIEALVDEIYSTLKGSNDIKNIRLIDFLFTLKDFVNHVRAEQSKLPDLSMPIEAYIRQLLVDPDVVPIVSEKKKELRVRPSTRKEIFLINGTHLAVPAEAPIEIYGLKLRLKTFSPQCFMRMAEIGSFSPETLGYVASGANLTNFIRVFMKCVDQETWKKNGEGVVVTTKENIIQFTHQYIELYKFLRSGGHSWLINRLAEEMVHRKLDREDQGSHISNIVETEEIEPEENIKRVIFFLKELSTMYSVSPVFTSGYMPLLYDLYRAGYLEVLWNPVEQKFLQHAEQREKEQMILQQVDMKLTEVITQARQYFKIMEEKIGRVQSDAIREILTMEGKVDDPNSILQEVIKACGKQEAELITTEYLNIKKQWELQEKNACAHLKLVKQLRSGLQYAELLKVLESIRVLYKEKNNTTNWNLCKACGFKLLCPHVDMLIQLQAAEASYDTMRTKLMKFSGINKEKENNQGLIYSYFCKICGEELAHFIQEDRTADVGIIGDLNSKLRVFIWQETMKACTFIHFGKLVDVKQFANIAVNVCLPLVYSIENIKKEEDYDPLTQLYAVIYIYAYILNLIYSSQKNKEFLTITIHGMKADSSLNAYVTFLLEKMMQQYSGIINQLSEITDQWIANNFREAFKKIIHQNGLQGLSVQDDTKVLLTEILLDPMYDYAATVARIDGSIPMHKPRTPKEAEYEFKTVIGRTPAELLSQKEFYDKIYTSKYRPDFTQLTRLNDIYFQEESLRVWWGGRDEEKTSTLIYLRAYELFLKYLQNAPNFNSELAEFKTYENAYGEQKALLAQQGFYNIFDPNTGRADQRTRLFEYKRLPISTLYDERGLPHKWTIYVYKAVDSSQKPAEIEVTRKDVIKKIDNHYALADLRCSVCHVLQHEVGQLNIKKVQTALKASLEFNTFYAFYESRCPKGGLHDFQDKKCVKCGLFTYIIYDHLSQPELVHDYYNNYKDQYDKEKMSIRSIQIKKDMTTPSTETQPKPPQEPWTFDYGKIIKTAKILDISPAVIEAIGAMEGRSYADIREGQGAPPPPTSMDDPRLMAVDSAVRIFLYNYNCLRHVSTFNKPPIHVERLVKHLSYEEKEDLEKVLPNVVNEYHTTFKHLRVTDPASALLYSIEFLCISFLTLYEIKEPSWVVNIVREFALTELNTIIQSEKLLSKPGAFNFMIFGEDFVCSGEDSSMDDISAYSSPGLFGEDIIDRLDDPFSIEDVDISLDVLDNLAPQ

SEQ ID NO: 319 - protein, 448 aa, African swine fever virus
MSNESFPETLENLLSMLQTKQQNAIQSEVIEWLHSFCETFHLKIHCHKQFIPSGEKKRAKIPAQETQGNTQPSHHVYRVVLSRAQPVKAQESLLTTMCNGLVLDANTWTCLAIPPPAPFQQATRQVQHFYRNNFYEVVPIQDGTLLTIYHWDDPEYGPSWCLASTHGYDVSNYCWIGDKTFAELVYELLQQHSTCDVTLEKNKTRGTRLFFDNLNPDYCYTIGIRHHNLQPLIYDPQNIWAIQSTNLKTLKTVYPEYYGYIGIPGIQSQVPELPQYDLPYLIRSYKTAMNQAKNAIKNGKKDKGYFNYGYLLISRAPAITKSTSNVLLKSPLLVFLQKSVYQKKHNISNSQRLEFIILQNYLMQHFRDHFIALFPQYISYYTKYQNMLNMIIHSIATKDKDHPFAGAVVKKVLEDIENAENIIDHTTIQNYAHQSKYAMLYLSIISHF

SEQ ID NO: 320 - protein, 129 aa, African swine fever virus
MEHPSTNYTPEQQHEKLKHYVLIPKHLWSYIKYGTHVRYYTTQNVFRVGGFVLQNPYEAVIKNEVKTAIRLQNSFNTKAKGHVTWAVPYDNISKLYAKPDAIMLTIQENVEKALHALNQNVLTLASKIR

SEQ ID NO: 321 - protein, 79 aa, African swine fever virus
MDQEQLFDKLYSLNLQLTAKNDQKKENRFFIRSGKKIQRIQMMMFITVYDINQKQKKRYGLRGCNLNLKATVLPLHKRI

SEQ ID NO: 322 - protein, 717 aa, African swine fever virus
MTKLAQWMFEQYVKDLNLKNRGSPSFRKWLTLQPSLLRYSGVMRANAFDILKYGYPMQQSGYTVATLEIHFKNIRSSFANIYWNRDSEEPEYVCCCATYQSHDGEYRYRFVWYQPFIEAYNAIEAALDPLETIILNLIAARDLDFVVHIFPYNKGHEDYLASTQLILKIFIATLLMDILRIKDNTLDVHLNSDYIIVMERLWPHIKDAIEHFFEAHKDLLGYLIAFRNGGNFAGSLRPSCGQKIVPLTIREVLQMNDINLAVWREVFIMQECSDLVINGIAPCFPIFNTWTYLQGINQIFFENTSLQEKFKKDFIARELSKEIIKGQKTLNDKEFKKLSLHQIQYMESFLLMSDVAIMITTEYVGYTLQSLPGIISRSSYLSPIVKNILMDEDSFMSLLFDLCYGAYVLHKKENVIHADLHLNNMTYYHFNPTSFTDRNKPGKYTLKVKNPVIAFITGPKVETETYVFKHIDGFGCIIDFSRAIMGPNHAIKLERQYGLAFVNTFYRNQSEHILKVLRYYFPEMLTNRENEIQGVILSNFNFFFNSITAIDFYAIARNLRSMLSLDYLHTSEVKRNVEISQTFLDTCQFLEEKAVEFLFKNLHTVLSGKPVEKTAGDVLLPIVFKKFLYPNIPKNILRSFTVIDVYNYNNIKRYSGKAIQTFPPWAQTKEILTHAEGRTFEDIFPRGELVFKKAYAENNHLDKILQRIREQLANENL

SEQ ID NO: 323 - protein, 105 aa, African swine fever virus
MKICKACSSCMVRTYVDGNIIFRCSCGESVQGDSQNLLVSSKVYHTGEMEDKYKIFIKNAPFDPTNCQIKKDCPNCHLDYLTQICIGSQKIIILVCRCGYMSNRG

SEQ ID NO: 324 - protein, 257 aa, African swine fever virus
MYSVCDVVRDAVAQSHLCACPNDKLPQCKGVTKAPPKCSVFHVAKLQDTKFKWKYTLDPLKAQKLSQIDKDIEKDAITLKLIYGIELSPEDLEWWKMQRCLINKKTGAKGGQFANKYLERQDLELLGYSPTPIIGGDFMFTALPDKVLRTIPVAWDRFLNPAMMIFFLIILLCVILGIFYVLVRNTLRRKQKSKQHQMEIKRFIKEKEQDPYIHTSFESWPADPNKEWKDLIPVYEAQGYCMADYRKKLGMPPGPNC

SEQ ID NO: 325 - protein, 475 aa, African swine fever virus
MTSLLKTDFNVSKYRLIAQKREANAVEIEAALEVVREFIIKKKLILYGGIAIDYALHLKGSSIYPEGERPDFDMFSPNHVEDAYELADILYEKGFKQVGTVRAIHVQTMRVRTDFVWVADLSYMPPNIFNTIPTLTYKNLKIIHPDYQRAGLHLAFCFPFDNPPREDVFSRFKKDLQRYNLIEKYYPIPVVPVKSTYESKTFSIPFKQVAIHGFAAYALLYQTLNELRITCKVPEWKTEFPQPSYSYHKNDKNITLTVDMPKAYPALVLATYNPEEVIKEMGLHLTEICEPYMDYSPPIFKTNDIHFFSTMFKELAISIIQDNLIVVSPQYLLLYFLYGAFATPADKSLFLFYYNATLWILEKADSLLNIIQKQTSPEEFTRFANTSPFVLTTRVLSCSQERCTFSPAYRISLANDVQQSQLPLPKTHFLSNSLPDVSTLPYNYYPGKGKDRPTNFSYEKNLLFNIGGKCTPSAM

SEQ ID NO: 326 - protein, 315 aa, African swine fever virus
MDALLKEIEKLSQPSLQKENNDVCDLCFMQMKKISNYQLLCEECGQLKDWFEPEYNEKFTVYSRLKIVGANSSYHQRDLDKANSSDYSSLQFHHILEELKSLNVKYMDAGQKPFPIQVLKETAHSYNQVQQHRVIRSITKLQILASILRSICLKLNIACTVADAARFTQLNTKGISRGMDLLRSLFVDNKITLNVDLNPIDSFINSTYSALQIKQIHQELQEENVYNLKEIVKSFILYADEKNIGVDLNRRTVVIATMYNVLRRAYYPIEIDTVVYQCKIRKNTITRALKMYEDYYSHFKSLYEQYHLNAAKKLI

SEQ ID NO: 327 - protein, 147 aa, African swine fever virus
MADNDNEDLIMDDLVEEYVETEEENLVDSEEESEDKDEIVESPSICEGFVQASSQTLVIIPDNERITSNVLTTFEATRLVAVRAQQLAINGSTMLKKKYSSPIDIAKQELFNRKIPLLVMRCIKVTPEGQKIVEIWNPREMGIPLLD

SEQ ID NO: 328 - protein, 62 aa, African swine fever virus
MNWGSISSGTPGLFVESIRNTPSVVKINVIFLKVISNTAVSVFWRDRRIRFESDWLNSYFQK

SEQ ID NO: 329 - protein, 962 aa, African swine fever virus
MREESWEDHDTIQLTAQRKYLAEVQALETLLTRELSVFLTEPGSKKTNIINRITGKTYALPSTELLRLYEHLEQCRKQGALMYFLERQGTYSGLMLDYDLKLNTNAVPPLEPPALSRLCHRIFVHIKNSSVLPEGSHKIHFFFTLKPEVVQGKYGFHVLIPGLKLAASTKKSIIGSLQHDATVQKILHEQGVTNPESCLDPHSASVPSLLYGSSKLNHKPYQLKTGFELVFDSSDPDYIPIHQIKNLESYNLVSELSLTNEQGSLVRPVYCAADIAAEKEEEIPTEDHSLSILMLHDPEARYLHKILNLLPPEYYVEYPLWSNVVFALANTSANYRPLAEWFSQKCPEKWNTGGKEKLEKLWNDASHHTEKKITKRSIMYWAHKHAPQQYKEIVEQGYFSILAEYVYSYNGMLEHYMIAKVIYAMMGNKFVVDVDSNGKYVWFEFVLPGQPMNQGEIWKWRKEVNPDELHIYISENFSRVMDRITEHIKYHLSQPHESNILNYYKKLLKAFERSKSKIFNDSFKKGVIRQAEFLFRQRSFIQTLDTNPHLLGVGNGVLSIETIPAKLINHFHEHPIHQYTHICYVPFNPENPWTKLLLNALQDIIPELDARLWIMFYLSTAIFRGLKEALMLLWLGGGCNGKTFLMRLVAMVLGDHYASKLNISLLTSCRETAEKPNSAFMRLKGRGYGYFEETNKSEVLNTSRLKEMVNPGDVTARELNQKQESFQMTATMVAASNYNFIIDTTDHGTWRRLRHYRSKVKFCHNPDPSNPYEKKEDPRFIHEYIMDPDCQNAFFSILVYFWEKLQKEYNGQIKKVFCPTIESETEAYRKSQDTLHRFITERVVESPSAETVYNLSEVVTAYAEWYNTNINVKRHIALELSQELENSVLEKYLQWSPNKTRILKGCRILHKFETLQPGESYIGVSTAGTLLNTPICEPKNKWWEWSPNPSAPPEKEASAPTP

SEQ ID NO: 330 - protein, 52 aa, African swine fever virus
MKKKDAYEQAKAYNILNVAFLLPVMALPKDMLLRIFPKELVQTLLSQEGQRD

SEQ ID NO: 331 - protein, 962 aa, African swine fever virus
MGKPTLLEPGHLYNVPAEHKNDVPIHYIITWIKQRLPEFGGAIPTSLADRVLIIKSRTGSGKSTALPVHVFRILRNENTHSFQKYLGRSVICTQPRVLTAVTLAKDIGASTHYPDMILGQTVGYQTKPLTEKPNRGLIYATAGVLLAQLHTMTDDEIASRYAFMIIDEAHERALGIDLMLMYIKSMLQRMLQRGSIGALRIPFVILTSATIDTHKYSTYFGIGKENIILVEGRQYGVETHWPLYNTNNYIKTACETALTIHKENIHDRPTEADILIFMPGMAEIRFLSMLLNNANMDLAKEKLPLMLILPIDSEAIAQENEAYLGLKAEIKNLWVKNPLTAKVEKPLRRVIVSTVVAETGLTIETLKYVIDPGWNRSIETYYPEWAGGLITRPAAQSRIEQRKGRVGRVFPGHFYPLYTKHVFEQIPVQQYPEIITEGPGAIFLSIVVETIKKNKEGVFKAEEIDMLDPPPTDALASAIERAIVAGLLTRGEKGLQLTQLGDIASRFSFLSIEEARMCFSGYFWQAAISDIATILAVVSVADKKLTNLLDSKQRNGAMLAEAVLAGIPPFLQNIDNAYTNIHLLLADDLLEGLFIFEGFQHAIVYFINNKVNNVAKHLREWCEKKMLKYSSMVQILARREDILNELAIVGLNPFHQWQNRLASANAETFLKRVCTLKQCMYEAYRLNCFCYDEHRLLYTGRNGIHFSYHDAVIKNPSCIVTPRIMLSPVSKQYMEWRLEPSFVSVLDGFVNVDINFLLPRQEIPNILGGVENEEEEPPLPIQVFLHKYVKTHFHFSGKSFKELKMKPSQMIKFPETTLINMIPDIPKNVVQTYLEINVCHRYSFKRLIYCETFYTDMDDVQHENSVELIGLPMAAHHLTINDFNKLYHLLKPDGFLIMYDLHQGQEAFWLHSLQDALGHHTIRRDMDFHTIPEWETIFKECGFTPIFSKQPSEHELFIVFKK

SEQ ID NO: 332 - protein, 119 aa, African swine fever virus
MLHWGPKYWRSLHLYAIFFSDAPSWKEKYEAIQWILNFIESLPCTRCQHHAFSYLTKNPLTLNNSEDFQYWTFAFHNNVNNRLNKKIISWSEYKNIYEQSILKTIEYGKTDFIGAWSSL

SEQ ID NO: 333 - protein, 318 aa, African swine fever virus
MLHLIYISIIVVLIIILISYTRKPKYFRITAPRSVALFHGIHPLNPKNYKTFSEEFETILNNAIEDGDFKGQLTEPCSYALRGGKYIRPIILMEIVRACQLQHSFGAPIYPAEAALAAEYFHVASLIIDDMPSFDNDVKRRNKDTVWARFGVAKAQMSALALTMQGFQNICRQIDWIKEHCPRFPDPNQLGALLCTFVSHSLNSAGSGQLVDTPEKTIPFFKIAFIMGWVLGTGSVEDIGMIERAAHCFGHAFQLADDIKDHDTDTGWNYAKIHGKQKTFDDVAQSLQECKKILHGKKIFTSIWNEIFQKVINVALGT

SEQ ID NO: 334 - protein, 438 aa, African swine fever virus
MYHDYASKLLADYRSDPPLWESDLPRHNRYSDNILNSRYCGNKNGAAPVYNEYTNSPEKAEKGLQLSDLRNFSFMLNPQHKNIGYGDAQDLEPYSSIPKNKLFNHFKNHRPAFSTHTENLIRRNVVRTEKKTFPQVASLKGTQKNCLTQPSSLPSLKNPKNSSVPSTRFSEHTKFFSYEDLPKLRTKGTIKHEQHLGDQMPGQHYNGYIPHKDVYNILCLAHNLPASVEKGIAGRGIPLGNPHVKPNIEQELIKSTSTYTDVPMLGPLPPKDSQHGREYQEFSANRHMLQVSNILHSVFANHSIKPQILEDIPVLNAQLTSIKPVSPFLNKAYQTHYMENIVTLVPRFKSIANYSSPIPNYSKRNSGQAEYFDTSKQTISRHNNYIPKYTGGIGDSKLDSTFPKDFNASSVPLTSAEKDHSLRGDNSACCISSISPSL

SEQ ID NO: 335 - protein, 164 aa, African swine fever virus
MNVDFIAGINNLGEKIYTCEPFKTSFQNPFIVALIITAVVLVVFFAICNPPVDKKRKTKTAIYVYICIVALLFLHYYVLNHQLNDIYNKSNMDVIVSSIHDKYKGGDEIIPPISPPSVSNELEEDQPKKIPAGPKPADSKPVSLPDSKPLVPLQEVIMPSQYNN

SEQ ID NO: 336 - protein, 475 aa, African swine fever virus
MDQEESHVISIFETLGAYFINIFYNFLYKNALYKKHSIVTEYQYQVKGYILGVKQNKKLYEKMLDSFYKYFCNITQINSKTLNFSNFVTTIVDSFIPKEYSQSISLEKKESILELLLCDYISNLGTFITTEKMLPFIIKNRKENYHKVTKEMQDYSLTFLLKKRMELYNKFLRKQAYVEPETELEETYARLSSYNRSLLHQIEELTSENKSLLADLSTLRKKYEKRQSEYRRLVQLLYQQIQRSSTSKSSYPLTKFIETLPSEHFSNEEYQKETPADQKEVVEMELLRKQELLTSQELTSKSPNNYPVPHSRTIVSKPLDNYPVPRSRTTTKIDFDNSLQNQELHTKNGFSEKDIVEFGQDKPEEENILAIDQDKPEEETILAIKQDISEEDNIFAIDQDKPEFNQDTPEFKEAVLDIKENILEEENQDEPIVQNPFLENFWKPEQKTFNQSGLFEESSNFSNDWSGGDVTLNFS

SEQ ID NO: 337 - protein, 354 aa, African swine fever virus
MALTTHSGKLIPELQFKAHHFIDKTTVLYGPSKTGKTVYVKHIMKILQPHIEQILVVAPSEPSNRSYEGFVHPTLIHYRLWLADKQKKNDNKGAERFLEAIWQRQTMMSSIYSRVNNIDMLKTLYHKLPIDIQQKENKNIAKVECLKAEQTDQKKEEKITSLYQQLLKKIIIQNIHMYKNLCLTEDEKFTLNYINLNPRLLLILDDCAAELHPLFTKEIFKKFFYQNRHCFISMIICCQDDTDLPANLRKNAFVSIFTNASICMSNFSRQSNRYSKQDKEYVEEISHIVFKGYRKLVYIREDEHRQHFYHSTVPLPTAFSFGSKALLKLCKAVYSKEVVIDKSNPYWSKFRLNF

SEQ ID NO: 338 - protein, 530 aa, African swine fever virus
MAEFNIDELLKNVLEDPSTEISEETLKQLYQRTNPYKQFKNDSRVAFCSFTNLREQYIRRLIMTSFIGYVFKALQEWMPSYSKPTHTTKTLLSELITLVDTLKQETNDVPSESVVNTILSIADSCKTQTQKSKEAKTTIDSFLREHFVFDPNLHAQSAYTCADTNVDTCASMCADTNVDTCASMCADTNVDTCASTCTSTEYTDLADPERIPLHIMQKTLNVPNELQADIDAITQTPQGYRAAAHILQNIELHQSIKHMLENPRAFKPILFNTKITRYLSQHIPPQDTFYKWNYYIEDNYEELRAATESIYPEKPDLEFAFIIYDVVDSSNQQKVDEFYYKYKDQIFSEVSSIQLGNWTLLGSFKANRERYNYFNQNNEIIKRILDRHEEDLKIGKEILRNTIYHKKAKNIQETGPDAPGLSIYNSTFHTDSGIKGLLSFKELKNLEKASGNIKKAREYDFIDDCEEKIKQLLSKENLTPDEESELIKTKKQLDNALEMLNVPDDTIRVDMWVNNNNKLEKEILYTKAEL

SEQ ID NO: 339 - protein, 385 aa, African swine fever virus
MDEIINKYQAVEKLFKEIQQGLAAYDQYKTLISEMMHYNNHIKQEYFNFLMIISPYLIRAHSGETLRNKVNNEIKRLILVENINTKISKTLVSVNFLLQKKLSTDGVKTKNMWCTNNPMLQVKTAHNLFKQLCDTQSKTQWVQTLKYKECKYCHTDMVFNTTQFGLQCPNCGCIQELMGTIFDETHFYNHDGQKAKSGIFNPNRHYRFWIEHILGRNPEQELGTKQDPCGTKVLQQLKKIIKRDNKCIALLTVENIRKMLKEINRTDLNNCVSLILRKLTGVGPPQISESILLRGEYIFTEAIKIREKVCKKGRINRNYYPYYIYKIFDAILPPNDTTNRRILQYIHLQGNDTLANNDSEWESICMELPEIKWKPTDRTHCVHFF

SEQ ID NO: 340 - protein, 646 aa, African swine fever virus
MASGGAFCLIANDGKADKIILAQDLLNSRISNIKNVNKSYGKPDPEPTLSQIEETHLVHFNAHFKPYVPVGFEYNKVRPHTGTPTLGNKLTFGIPQYGDFFHDMVGHHILGACHSSWQDAPIQGTSQMGAHGQLQTFPRNGYDWDNQTPLEGAVYTLVDPFGRPIVPGTKNAYRNLVYYCEYPGERLYENVRFDVNGNSLDEYSSDVTTLVRKFCIPGDKMTGYKHLVGQEVSVEGTSGPLLCNIHDLHKPHQSKPILTDENDTQRTCSHTNPKFLSQHFPENSHNIQTAGKQDITPITDATYLDIRRNVHYSCNGPQTPKYYQPPLALWIKLRFWFNENVNLAIPSVSIPFGERFITIKLASQKDLVNEFPGLFVRQSRFIAGRPSRRNIRFKPWFIPGVINEISLTNNELYINNLFVTPEIHNLFVKRVRFSLIRVHKTQVTHTNNNHHDEKLMSALKWPIEYMFIGLKPTWNISDQNPHQHRDWHKFGHVVNAIMQPTHHAEISFQDRDTALPDACSSISDISPVTYPITLPIIKNISVTAHGINLIDKFPSKFCSSYIPFHYGGNAIKTPDDPGAMMITFALKPREEYQPSGHINVSRAREFYISWDTDYVGSITTADLVVSASAINFLLLQNGSAVLRYST

SEQ ID NO: 341 - protein, 125 aa, African swine fever virus
MAVYAKDLDNNKELNQKLINDQLKIIDTLLLAEKKNFLVYELPAPFDFSSGDPLASQRDIYYAIIKSLEERGFTVKICMKGDRALLFITWKKIQSIEINKKEEYLRMHFIQDEEKAFYCKFLESR

SEQ ID NO: 342 - protein, 115 aa, African swine fever virus
MGYTIQLDKDGDYCWDEDPTHHDPYMQANATSHVATSYATTSHAATPHAAAHHTFHEPFIKLNLTDKNIFNGLGFILIVIFIYLLLITLQQMLTRHIYNTVQHCVKAHLDSKNLQ

SEQ ID NO: 343 - protein, 412 aa, African swine fever virus
MEDTTFLEGANLAGITTLMNNLHINEQANLEELEKQVMGKQQSFPTDHFDEELNGLAKSLGINFNDPEFSLDSPHSIISKKPSGRGGDKVHGGIRRDSVCTDSICSDSVCSGSIRSGSIRSGSIRNGSIRSGSVRDGSIRNGSVRSGKTRRGLACNSSSRNDRGYSLSTHRKKYAESEASQKTAISKRDRKNHYAESEYSEKSIKPSTKQVDRLINHLRSNGDPNSFYKKDHDYERKTKLVKLEKINMLLTYLGNEQISTDDIKIPTIDSSMQEIDDVIEMLTLRNVGIRYSSIAEEILIGLARGLEIVFDGTREIPFLNYRPDYTGLHNTFMIKLFKMRYETSQVVGNLVQNMSPLSKICLELGPSLLLYPALIRTKHKASEDLYNLLQKGPEDPFTAYNEIHETLKKNNK

SEQ ID NO: 344 - protein, 175 aa, African swine fever virus
METNCPNILYLSGITIEECLQSKKTATDTLNTNDDEAEVEKKLPSVFTTVSKWVTHSSFKCWTCHLYFKTVPKFVPTYMRENERGEIEMGVLGNFCSFSCAASYVDVHYTEPKRWEARELLNMLYRFFTSQWISYIKPAPSYTMRKEYGGKLSEEAFISELHTLEESISSKHIFI

SEQ ID NO: 345 - protein, 263 aa, African swine fever virus
MEDETELCFRSNKVTRLEMFVCTYGGKITSLACSHMELIKMLQIAEPVKALNCNFGHQCLPGYESLIKTPKKTKNMLRRPRKTEGDGTCFNSAIEASILFKDKMYKLKCFPSTGEIQVPGVIFPDFEDGKNIIQQWVDFLQHQPIEKKIQIIEFKTIMINFKFQINPVSPRVIIHLKKFAALLEHIPTPYPIREIKPPLEDSKVSAKFMVSPGKKVRINVFLKGKINILGCNTKESAETIYTFLKDLISVHWQEILCVLPVPD

SEQ ID NO: 346 - protein, 66 aa, African swine fever virus
MDIKRALILFLLFLVVLSNAFVDYIISNFNHAVTCRKPTYFGIVLQGIFLVILFSIVDYLINENIL

SEQ ID NO: 347 - protein, 1340 aa, African swine fever virus
MDFQNDFLTNPLRVTLYNPVENEYTKTFIFLGSVPANVLQACRKDLQRTPKDKEILQNFYGEDWEKKLSQYVVGGDSDDLDEFEKLFVEDRGEETNVMMPEIETMYSEYSIFPEDTFKDIREKIYVATGIPPYRQHIFFFQNNALQVTYRLLLSGSGVALDIRDYKKEFQQVGGVNIDASMESQKDELYVEALDSFQLIKNIHHIFVADLNTLVAPMRRQISIAIEDNYQFDLLYYGLIMKYWPLLSPDAFKLLVQSPLQMEKQYPALSPSLTSLKKRLLLEQKLINFTYARAQQVIAKYEGNRLTRGTLAVTSAMIKISPLVNIQINVRNVFDLFPATPDIPQLVVFFYSKTGPTVVSKHHITSTEPEKFSNKTFRVPTIILIRFINKKAFILTIQNNGHYFIESNWSENERHDFNSVVSTLNNFINPIIHTINDMGPAAFPRGGSLPLPSNEDIQISISSMSVSTFWPYTLSSKGFTELKSRWREYEQAGIISVRGLQQTGVYNFLFKKGIYSYDPHEIERMIIISSGPGRKMDINVALLQNTYAYLFDTNVAARWETIYGGRNIRIYHRVTDIKIEMFNITQEEFNYLWVYLFVFLDNLITGPDKILVNKLSQLHDKQQGKGASQLRALQEQDPDLYDLRKYDTQATVYSVLCQHPRPPVIYSEAEVKSMPPAKRKELVKYWNFTEGVPAYYSCPHPDYPHLSLLEGRHPLNYCLPCCQKTKALLGTKRFYINNTCLTKHTFVEQDLEDLNTQTSRHTLSYGKKIPVNRIAFLPHQIADELFLNTIKEPDIFCIVGVEQTMLGISNAGLFYSLARILDLAPKALAIEIAKAANTPQYYILGNGAGNMFSSGAELANLILQTFVEQKNQLLQWDTTWQDIFLDLVAICYDLHCVFFKDKQGDIGFEVSPSTIQKILSPSKKIAIIFDTDEGIYPMAITQQKRFLKNSEAQYIFTEDDPVMEVIQSMSEFMCKDNWWDIHDVKNIPGYTVGKKLINRHNFCYALLIDSDTDRPIYFPIRLSSYIHDDIPIDFDLRPTQIASFEETWKFITLFNKQYKQYEIVPSAVLQNIKKEFVGFLSEGKTGLYFYYAPTQTLPATLEKLPIATLTIDPRDIDQAILYPLEEPYPQQNKANKAFYINHLYKFLLIEFFDVLYGLQSNSTRKHIENLFQKTDFQKITSVTEFYTKLSDFVDLNDIHTIKHILETTDAEHALKVLQKNIFNFDYTLLSPLQSYTYDELCQHLKKLLTPRIEFYEDIETIDRGLINIYTSCQYSTLNQPQCKKKRLRIPVNHFENYIHILAADILNPLKHSTLLLTGLGVIDDLQFILRPQEIISVKNKF

SEQ ID NO: 348 - protein, 1206 aa, African swine fever virus
MISIMDRSEIVARENPVITQRVTNLLQTNAPLLFMPIDIHEVRYGAYTLFMYGSLENGYKAEVRIENIPVFFDVQIEFNDTNQLFLKSLLTAENIVYERLETLTQRPVMGYREKEKEFAPYIRIFFKSLYERRKAITYLNNMGYNTAADDTTCYYRMVSRELKLPLTSWIQLQHYSYEPRGLVHRFSVTPEDLVSYQNDGPTDHSIVMAYDIETYSPVKGTVPDPNQANDVVFMICMRIFWIHSTEPLASTCITMAPCKKSSEWTTILCSSEKNLLLSFAEQFSRWAPDICTGFNDSRYDWPFIVEKSMQHGILEEIFNKMSLFWHQKLDTILKCYYVKEKRVKISAEKSIISSFLHTPGCLPIDVRNMCMQLYPKAEKTSLKAFLENCGLDSKVDLPYHLMWKYYETRDSEKIADVAYYCIIDAQRCQDLLVRHNVIPDRREVGILSYTSLYDCIYYAGGHKVCNMLIAYAIHDEYGRIACSTIARGKREHGKYPGAFVIDPVKGLEQDKPTTGLDFASLYPSLIMAYNFSPEKFVASRDEANSLMAKGESLHYVSFHFNNRLVEGWFVRHNNVPDKMGLYPKVLIDLLNKRTALKQELKKLGEKKECIHESHPGFKELQFRHAMVDAKQKALKIFMNTFYGEAGNNLSPFFLLPLAGGVTSSGQYNLKLVYNFVINKGYGIKYGDTDSLYITCPDSLYTEVTDAYLNSQKTIKHYEQLCHEKVLLSMKAMSTLCAEVNEYLRQDNGTSYLRMAYEEVLFPVCFTGKKKYYGIAHVNTPNFNTKELFIRGIDIIKQGQTKLTKTIGTRIMEESMKLRRPEDHRPPLIEIVKTVLKDAVVNMKQWNFEDFIQTDAWRPDKDNKAVQIFMSRMHARREQLKKHGAAASQFAEPEPGERFSYVIVEKQVQFDIQGHRTDSSRKGDKMEYVSEAKAKNLPIDILFYINNYVLGLCARFINENEEFQPPDNVSNKDEYAQRRAKSYLQKFVQSIHPKDKSVIKQGNVHRQCYKYIHQEIKKKIGIFADLYKEFFNNTTNPIESFIQSTQFMIQYFDGEQKVNHSMKKMVEQHATASNRAGKPAGNPAGNALMRAIFTQLITEEKKIVQALYNKGDAIHDLLTYIINNINYKIATFQTKQMLTFEFSSTHVELLLKLNKTWLILAGIHVAKKHLQAFLDSYNNESPSRTFIQQAIEEECGSIKPSCYDFIS

SEQ ID NO: 349 - protein, 122 aa, African swine fever virus
MPSTGTLVIIFAIVLILCIMLLFFYKTVEAGKSGVLPPPIPPPTPPPKKKYDHNEYMEKTDLEPEVKKNHRKWANEAEHLISSSVKGLENLDETAFLANHKGHGFRTFDHAKSLFKEFLKKY

SEQ ID NO: 350 - protein, 2476 aa, African swine fever virus
MGNRGSSTSSRPLPSSEANIYAKLQDHIQRQTRPFSGGGYFNGGGDKNPVQHIKDYHIDSVSSKAKLRIIEGIIRAIAKIGFKVDTKQPIEDILKDIKKQLPDPRAGSTFVKNAEKQETVCKMIADAINQEFIDLGQDKLIDTTEGAASICRQIVLYINSLTHGLRAEYLDVHGSIENTLENIKLLNDAIKQLHERMVTEVTKAAPNEEVINAVTMIEAVYRRLLNEQNLQINILTNFIDNILTPTQKELDKLQTDEVDIIKLLNDTNSVLGTKNFGKVLSYTLCNLGIAASVANKINKALQKVGLKVEQYLQSKNWAEFDKELDLKRFSGLVSAENIAEFEKAVNLLRQTFNERHKILENSCAKKGGDEEKTPLDRRIEAQRLDRKHILMEFLNKSTQAYNDFLENVKKIGIKLVKEIALTPNITRLRDALSRINDMGTIALDLSLIGFYTNAAAREERETFLTQLTLVKNVLEEISKTDPNFKNLYDSCSRLLQIIDFYTDIVQKKYGGEEDCECTRVGGAALTVEELGLSKAARSQVDLNQAINTFMYYYYVAQIYSNLTHNKQEFQSYEENYATILGDAIAGRLMQLDTEKNARINSPAVDLARGHVGPNPGGAQEVDWKATVSAIELEYDVKRRFYRALEGLDLYLKNITKTFVNNIDSIQTVQQMLDGVRIIGRWFTETTGDTLAQVFESFPTSTGNDSNVFTDNAPAGHYYEKVAAEIQQGRSVGTLRPVRASQAKNIRDLIGRSLSNFQALKNIINAFARIGDMLGGEELRQMVPMSPLQIYKTLLEYLQHSALSVGLKNLNQSEIGGQRMALAQTAEEAAQRVYLSTVRVNDALSTRWETEDVFFTFMLKSMAAKIFIVLGIYDMFERPEPVYKLIPTRMILGGADELEPEVIPEAAELYFRLPRLAEFYQKLFSFRDENVQISMLPELEGIFSGLIRIIFMRPIELINIGDYSETEIRQLIKEINVIYQHFNLEYGEQEATKKALIHFVNEINRRFGVITRTEWEKFQRIVQEARTMNDFGMMNQTNYSILPDEDGYTQSSQLLPSDRFISPSTQPTPKWRPALYNIDSVDVQTGMLQPNSQWDLVQKFRKQLSEMFEDPSLQQELGKISYQELIRQAINELKKEHTDKIQIVSKLIQGSESLADTDVNKIFLFHETVITGLNLLSAIYVLLNNFRNNIKGLDLDTIQKSIIEWLRETQAANVNRANLIDWLGRKHGAISEIRNPGLVIKEINMRLSMVYPDPTTEAAAAAQDRNLTTETLFAWIVPYVGIPAGGGVRPEQELAARYLVDNQRIMQLLLTNIFEMTSSFNKMVQVRFPETSTAQVHLDFTGLISLIDSLMADTKYFLDLLRPHIDKNIIQYYENRSNPGSFYWLEEHLIDKLIKPPTDAGGRPLPGGELGLEGVNQIINKTYTLLTKPYNVLQLRGGAQRRDAANIQINNNPQSSERFEQYGRVFSRLVFYDALENNSGLRVEQVALGDFRLSNLIRTNNAQEENTLSYWDNIALRTYANVNDAANNLRRYRLYGSDYGIQNNRSMMMVFNQLIASYITRFYDAPSGKIYLNLINAFANGNFSQAVMEMGYAHPDLARNNNVFGHRGDPTEQSVLLLSLGLILQRLIKDTNRQGLSQHLISTLTEIPIYLKENYRANLPLFNKMFNILISQGELLKQFIQYTNVQLARPNLTALLGANNDSVIYYNNNNVPATGLSVGQAALRGIGGVFRPNVTLMPLGDAQNNTSDVVRKRLVAVIDGIIRGSHTLADSAMEVLHELTDHPIYLETEEHFIQNYMSRYNKEPLMPFSLSLYYLHDLRIENNEVYDPLLYPNLESGSPEFKLLYGTRKLLGNDPVQLSDMPGVQLIMKNYNETVVAREQITPTRFEHFYTHAIQALRFIINIRSFKTVMMYNENTFGGVNLISENRDDKPIITAGIGMNAVYSLRKTLQDVISFVESSYQEEQINHIHKIVSPKGQTRTLGSNRERERIFNLFDMNIIPINVNALMRSIPLANIYNYDYSFEEIACLMYGISAEKVRSLDTTAPQPDVAEVLNIPNRPPINTREFMLKLLINPYVSVSITQYGNELLSKGNAGYMSRIFRGDNALNMGRPKFLSDQIFNKVLFGSLYPTQFDYDEAGPSLAAGIQRGRERWGHPMSIYINQALHEIVRTIRLAETVRGLRNVIDRNQIIGELNAFRTQLEDTRREVNNLIQTPEIQNNPTPEIIAAIQNWVQQYRGQITNLIDLIGNAGQANSMINLIQNITPQTAGAQLTALFNIRGLPAPPPRQALQNDIEAMQWFMTMVINHPPVLIAPFMLLVNNLKEFLNTLERYVYKTPRWLGPGTARIAQPPVGMAPGINMRHHTSYTENSVLTYITEQNREEGPWSIVKQVGVGIQKPTLVQIGKDRFDTRLIRNLIFITNIQRLLRLRLNLELSQFRNVLVSPDHIINPSITEYGFSITGPSETFSDKQYDSDIRIL

SEQ ID NO: 351 - protein, 201 aa, African swine fever virus
MDFILNISMKMEVIFKTDLRSSSQVVFHAGSLYNWFSVEIINSGRIVTTAIKTLLSTVKYDIVKSARIYAGQGYTEHQAQEEWNMILHVLFEEETESSASSENIHEKNDNETNECTSSFETLFEQEPSSEVPKDSKLYMLAQKTVQHIEQYGKAPDFNKVIRAHNFIQTIYGTPLKEEEKEVVRLMVIKLLKKISFYLTYI

SEQ ID NO: 352 - protein, 530 aa, African swine fever virus
MPSNMKQFCKISVWLQQHDPDLLEIINNLCMLGNLSAAKYKHGVTFIYPKQAKIRDEIKKHAYSNDPSQAIKTLESLILPFYIPTPAEFTGEIGSYTGVKLEVEKTEANKVILKNGEAVLVPAADFKPFPDRRLAVWIMESGSMPLEGPPYKRKKEGGGNDPPVPKHISPYTPRTRIAIEVEKAFDDCMRQNWCSVNNPYLAKSVSLLSFLSLNHPTEFIKVLPLIDFDPLVTFYLLLEPYKTHGDDFLIPETILFGPTGWNGTDLYQSAMLEFKKFFTQITRQTFMDIADSATKEVDVPICYSDPETVHSYANHVRTEILHHNAVNKVTTPNLVVQAYNELEQTNTIRHYGPIFPESTINALRFWKKLWQDEQRFVIHGLHRTLMDQPTYETSEFAEIVRNLRFSRPGNNYINELNITSPAMYGDKHTTGDIAPNDRFAMLVAFINSTDFLYTAIPEEKVGGNETQTSSLTDLVPTRLHSFLNHNLSKLKILNRAQQTVRNILSNDCLNQLKHYVKHTGKNEILKLLQE

SEQ ID NO: 353 - protein, 80 aa, African swine fever virus
MLIPVVCFTCGFPIGTYAAIFDKARTEYIKTKMGGTLPQNIPLDASLQIELKDLITALGIPMRVCCRTHLITTLDYRKYY

SEQ ID NO: 354 - protein, 307 aa, African swine fever virus
MTTHIFHADDLLQALQQAKAEKNFSSVFSLDWDKLRTAKRNTTVKYVTVNVIVKGKKAPLMFNFQNEKHVGTIPPSTDEEVIRMNAENPKFLVKKRDRDPCLQFNKYKISPPLEDDGLTVKKNEQGEEIYPGDEEKSKLFQIIELLEEAFEDAVQKGPEAMKTKHVIKLIQRKISNSAVKNADKPLPNPIARIRIKINPATSILTPILLDKNKPITLQNGKTSFEELKDEDGVKANPDNIHKLIESHSIHDGIINARSICISNMGISFPLCLEMGVVKVFEKNNGIDVNSIYGSDDISTLVNQIAIA

SEQ ID NO: 355 - protein, 174 aa, African swine fever virus
MLTLIQGKKIVNDLRSRLAFEYNGQLIKILSKNIVAVGSLRREEKMLNDVDLLIIVPEKKLLKHVLPNIRIKDLSFSVKVCGERKCVLFIEWKKNTYQLDLFTALAEEKPYAVLHFTGPVSYLIRIRAALKKKNYKLNQYGLFKNQTLVPLKITTEKELIKELGFTYRIPKKRL

SEQ ID NO: 356 - protein, 61 aa, African swine fever virus
MALDGSSGGGSNVETLLIVAIIVVIMAIMLYYFWWMPRQQKKCSKAEECTCNNGSCSLKTS

SEQ ID NO: 357 - protein, 1460 aa, African swine fever virus
MKFYYVFSKNMEAGYAEIAAVQFNIAGDNDHKRQGVMEVTISNLFEGTLPAEGGIYDARMGTTDHHYKCITCSHQRKQCMGHPGILQMHAPVLQPLFIAEIRRWLRVICLNCGAPIVDLKRYEHLIRPKRLIEAASSQTEGKQCYVCKAVHPKIVKDSEDYFTFWADQQGKIDKLYPQIIREIFSRVTYDTVVKLGRSKNSHPEKLVLKAIQIPPISIRPGIRLGIGSGPQSFHDINNVIQYLVRKNLLIPKDLQIVRGQKIPLNIDRNLQTIQQLYYNFLLDSVSTTATQGGTGKRGIVMGARPAPSIMRRLPRKEGRIRKSLLGSQVWSISRSTICGNSDLHLDEVGYPISFARTLQVAETVQHYNINRLMPYFLNGKRQYPGCSRVYKQITQSVHDIEGLKQDFRLEVGDILYRDVVTGDVAFFNRQPSLERSSIGVHRIVVLENPKISTFQMNVSACAWYNADFDGDQMNLWVPWSVMSRVEAELLCSVRNWFISTKSSGPVNGQVQDSTVGSFLLTRTNTPMGKNVMNKLHAMGLFQTTQTDPPCFANYSPTDLLDGKSVVSMLLRQTPINYQRAPTWYSEVYAPYMHYNKQDISTQIRNGELIEGVLDKKAVGAGSSGGIYHLISRRYGPQQALKMIFATQQLALNYVRNAGFTVSTADMLLTPEAHQEVQEIINELLLESEEINNRLLHGDIMPPIGLTTHDFYEKLQLNALKFPDRILKPIMNSINPETNGLFQMVATGAKGSNPNMIHIMAGIGQIEINTQRIQPQFSFGRTLVYYPRFALEAQAYGFICNSYIAGLTSPEFIFGEMNGRFDLINKALSTSSTGYANRKAIFGLQSCIVDYYRRVSIDTRLVQQLYGEDGLDARQLETVRFETIMLSDQELEDKFKYTGIQSPLFEEEFSRLKKDRDKYRQIFLNVENFNFSQLLTDVRQVPVNVASIVKNILLSSTSGVLPFDEKSILQKYAMVKTFCKNLPYVFINNIQERLQTPIPVYLKRAASLMRMLIRIELATVKTLNITCEQMSAILDLIRLQYTQSLINYGEAVGILAAQSVSEPLTQYMLDSHHRSVAGGTNKSGIVRPQEIFSAKPVEAEQSSEMLLRLKNPEVETNKTYAQEIANSIELITFERLILQWHLLYETYSSTKKNVMYPDFASDVEWMTDFLENHPLLQPPEDIANWCIRLELNKTTMILKSISLESIINSLRAKHPNTYIMHSVENTASGIPIIIRIYLRESAFRRSTNTRMATDEKIAVNVVDKLLNSTIRGIPGIKNANVVKLMRHRVDAQGKLVRLDNIYAIKTNGTNIFGAMLDDNIDPYTIVSSSIGDTMELYGIEAARQKIISEIRTVMGDKGPNHRHLLMYADLMTRTGQVTSLEKAGLNAREPSNVLLRMALSSPVQVLTDAAVDSAVNPIYGIAAPTLMGSVPRIGTMYSDIIMDEKYITENYKSVDSLIDML

SEQ ID NO: 358 - protein, 419 aa, African swine fever virus
MLNQFPGQYSNNIFCFPPIESETKSGKKASWIICVQVVQHNTIIPITDEMFSTDVKDAVAEIFTKFFVEEGAVRISKMTRVTEGKNLGKKNATTVVHQAFKDALSKYNRHARQKRGAHTNRGIIPPMLVKYFNIIPKTFFEEETDPIVQRKRNGVRAVACQQGDGSILLYSRTKKEFLGLDNIKKELKQLYLFIDVRVYLDGELYLHRKPLQWIAGQANAKTDSSELHFYVFDCFWSDQLQMPSNKRQQLLTNIFKQKEDLTFIHQVENFSVKNVDEALRLKAQFIKEGYEGAIVRNANGPYEPGYNNYHSAHLAKLKPLLDAEFILVDYTQGKKGKDLGAILWVCELPNKKRFVVTPKHLTYADRYALFQKLTPALFKKHLYGKELTVEYAELSPKTGIPLQARAVGFREPINVLEII

SEQ ID NO: 359 - protein, 868 aa, African swine fever virus
MASLDNLVARYQRCFNDQSLKNSTIELEIRFQQINFLLFKTVYEALVAQEIPSTISHSIRCIKKVHHENHCREKILPSENLYFKKQPLMFFKFSEPASLGCKVSLAIEQPIRKFILDSSILVRLKNRTTFRVSELWKIELTIVKQLMGSEVSAKLAAFKTLLFDTPEQQTTKNMMTLINPDDEYLYEIEIEYTGKPESLTAADVIKIKNTVLTLISPNHLMLTAYHQAIEFIASHILSSEILLARIKSGKWGLKRLLPQVKSMTKADYMKFYPPVGYYVTDKADGIRGIAVIQDTQIYVVADQLYSLGTTGIEPLKPTILDGEFMPEKKEFYGFDVIMYEGNLLTQQGFETRIESLSKGIKVLQAFNIKAEMKPFISLTSADPNVLLKNFESIFKKKTRPYSIDGIILVEPGNSYLNTNTFKWKPTWDNTLDFLVRKCPESLNVPEYAPKKGFSLHLLFVGISGELFKKLALNWCPGYTKLFPVTQRNQNYFPVQFQPSDFPLAFLYYHPDTSSFSNIDGKVLEMRCLKREINHVSWEIVKIREDRQQDLKTGGYFGNDFKTAELTWLNYMDPFSFEELAKGPSGMYFAGAKTGIYRAQTALISFIKQEIIQKISHQSWVIDLGIGKGQDLGRYLDAGIRHLVGIDKDQTALAELVYRKFSHATTRQHKHATNIYVLHQDLAEPAKEISEKVHQIYGFPKEGASSIVSNLFIHYLMKNTQQVENLAVLCHKLLQPGGMVWFTTMLGEQVLELLHENRIELNEVWEARENEVVKFAIKRLFKEDILQETGQEIGVLLPFSNGDFYNEYLVNTAFLIKIFKHHGFSLVQKQSFKDWIPEFQNFSKSLYKILTEADKTWTSLFGFICLRKN

SEQ ID NO: 360 - protein, 250 aa, African swine fever virus
MDTAMQLKTSIGLITCRMNTQNNQIETILVQKRYSLAFSEFIHCHYSINANQGHLIKMFNNMTINERLLVKTLDFDRMWYHIWIETPVYELYHKKYQKFRKNWLLPDNGKKLISLINQAKGSGTLLWEIPKGKPKEDESDLTCAIREFEEETGITREYYQILPEFKKSMSYFDGKTEYKHIYFLAMLCKSLEEPNMNLSLQYENRIAEISKISWQNMEAVRFISKRQSLNLEPIIGPAFNFIKNYLRYKH

SEQ ID NO: 361 - protein, 129 aa, African swine fever virus
MDINPLLYLQAFNNDATTFNTQGHILEQQSDSAYFDTFANAMQAYLDTKQGGNDEEGTIILMDDEDFNDSESLEDFLQMLSEEELNDGFSSDDEPEEHVILTEDNQGEPSETPQATFDITEFIKTDDED

SEQ ID NO: 362 - protein, 79 aa, African swine fever virus
MNKTIEYQKEFLKENNQLLSIPVKKNILKEILQNDEQDTIITNCITKEVSINLDLIKNPKVLYSIYIMVVEYLKSINIA

SEQ ID NO: 363 - protein, 339 aa, African swine fever virus
MIDQKIFETTLNIDDPTNFCTNVEAHLLKELENIYVGKCFKNSFILNITGVIQRSPCFIMRTNNSGRGYMHVRFSAVVSYLNAFDLIAAVKIIKNDSNIILGESLLTEPVTIVIPSSESQNNVAEVGQIVPVQLANSSVYYIPGRQQASATGSIFIPKHTFSVYHVQEELTQEQALNLTKLVNIIEMLLESRSKKDFKQICFFEKLYYTYSISSDEILDLKIWKGPKGKEMSRLKPCNVLSFLYDALKNKNSSLGFWARPPNLLKSSPLAYQQDQNSFNATELPIICSAEVMFVTLLKEIINYLQFINDLCDTFNNEQLIKRHENIWMLIEQRKIGHDF

SEQ ID NO: 364 - protein, 1133 aa, African swine fever virus
MAYPELDAADFLQQLARRKEFKSLISPPVDQKELIRDLRAHFVQIGGPGCEKGGRAFFPCDPYASPFPSIKGLQLHNAQLFVQNFQNPNTPYSRLLLNWQTGTGKSIAAIAIARQFMNHYMNFIENAPWIFVVGFTRAIIQTEMLRRPELGFVSYKEVAELHRLLHIAKQSGSTTSVESRHLNGFVSTLKRRLTDRNRGGFFQFYGYKEFASKLFNITSKGEEKNFDVLSLFHRSDEAEDTLNENDISQFVQKISEAETNGLIRVNQKIMEQLRGGLLIADEIHNVYNIQERNNYGIALQYVLDAFPPHQAPRAVFMSATPVTGSVMEYVDLLNLLVPRHELPNGQPLQRQQLFDSSGHSVKWKKDALALVERLSTGRVSFLLDTNTNFYPERIFAGKMLSYKDETLPYLHFIECPMSEYQLETLKQLGPDPKISSNAYSIYDMVFPNPKFSKQTEPKAYGLFNSTETPTALSMASTDWLLENGVQIIEPSRRAPFNVSGSFLSLQPPTHISGLAFYSGKYTQMMKDILSIIRQGRGKILIYHNRVRMSGVLILQEILQSNGILNEVSSPVGTTRCSICAAIRDEHTHSDHQFIPVRFTILHSEIEPAVRERSLALFNASSNLEGHQLRILIGSKVIVEGLNFQAVRYEMIMSLPLDIPRLIQVFGRVVRKNSHMELPPSERNVTIYLYVSTTPDGGPELAKYAQKLKEYILIQEGDKALRKHAIDGFTNQIKIDKPMLESLPLSPSITPANVGATVLNTFEAYGYGEQEVKTISNIIISLFMARPVWTYSELWKAVSTPKLIQGITIDNKLFSEDNFALALISLCYSKNQCKELWIQNRLCTIMHVPAKPEHLYVAAVLNHKKEPVLDIETYIRDFQPPAMHSIRITKYLEHSQTKEPFQVLYEKFQKDFQDEPMEQVLIHYPASFHYTMLEALIIDNLAGMGALVEVYKKFFIAFSKKDIQPFPDIFKIISHVPGDDNTLVGYATEDSVRLITSREDKTWHEIPLYMLNINVKRKENDIVIGYMESKGKALKFKIRPPIQVLKKNEITDIRMLNRGAVCETRGREEQQKIADQLGISLNLTKISAIKLCLLIRNNLLQKEMEARNQPNGMQDGIRWFYLFNDKMPSLVHTS

SEQ ID NO: 365 - protein, 117 aa, African swine fever virus
MDTETSPLLSHNLSTREGIKQSTQGLLAHTIAKYPGTTAILLGILILLIIILIIVAIVYYNRTIDCKSSIPKPPPSYYVQQPEPHHHFPVFFRKRKNSTSLQSHIPSDEQLAELAHS

SEQ ID NO: 366 - protein, 205 aa, African swine fever virus
MAMQKLFTYIYEFIEYRKMVLLEEKVPYDKFVQMVLNTGFFRINAETLNHGIVSVFIFGANGKYVHHGGDMRTLLTNTLNEKKHYEELILIVDKPVLSKKNILDIIVEQRAANPTIVINIYPYHLFCINIPKVSAIPKHKLITQEEAQEFLGREYLQPQDLMQISASDPPVVWLGGRPGDFVQIERPSETAMHAVVIRFITKSKI

SEQ ID NO: 367 - protein, 345 aa, African swine fever virus
METFVRLFKDSPQQRSDAWHAIRRTQVGGSDLASVLGLNPYKSYYITLAEKANLFKKNLNRAACSWGTLFERVSKDLLELFCQTTVIGDNIHIDGTYLGYPGHSNSPDGFCHLTLGYTQQSWEIKTIFNNVRYEATKRIPVLVEIKSPFNRKIKNSVPSYYMPQIQSGLALSPPISMGIYVEAMFRVCGIHQLGSNNETNTDIHPPESMLPLAWGIITICSTQEHTEAPQDFGTLDAETFRQLLETLYQKDQYTIHYSMPYETACPEMPNVVGYFGWKVFIFQIIPVMKHPQFLKDKYPIIQQFLRDLHTIKASPSPMEMYEKICCSEESALSTEDIDNFTDMLT

SEQ ID NO: 368 - protein, 183 aa, African swine fever virus
MSVVVGGVEYSLNNWARYEIKRRAAELESVNYYPHCEYIMPEDIVVSILGSKPNCPFLEALKRFHDFLKKRRIIFKGEYLVIPWMGAQDVADMIHHVENRINLDHLEDLAHMLKLITYHRSFDTCINQAFEHLYAFKFPDANIETHELKHIRQLEKKMYGYILRLEKLQTVLTFYIEFLLKQV

SEQ ID NO: 369 - protein, 273 aa, African swine fever virus
MSILEKITSSPSECAEHLTNKDSCLSKKIQKELTSFLEKKETLGCDSESCVITHPAVKAYAQQKGLDLSKELETRFKAPGPRNNTGLLTNFNIDETLQRWAIKYTKFFNCPFSMMDFERVHYKFNQVDMVKVYKGEELQYVEGKVVKRPCNTFGCVLNTDFSTGTGKHWVAIFVDMRGDCWSIEYFNSTGNSPPGPVIRWMERVKQQLLKIHHTVKTLAVTNIRHQRSQTECGPYSLFYIRARLDNVSYAHFISARITDEDMYKFRTHLFRIA

SEQ ID NO: 370 - protein, 1192 aa, African swine fever virus
MEAFEISDFKEHAKKKSMWAGALNKVTISGLMGVFTEDEDLMALPIHRDHCPALLKIFDEIIVNATDHERACHNKTKKVTYIKISFDKGVFSCENDGPGIPIAKHEQASLIAKRDVYVPEVASCHFLAGTNINKAKDCIKGGTNGVGLKLAMVHSQWAILTTADGAQKYVQHINQRLDIIEPPTITPSREMFTRIELMPVYQELGYAEPLSETEQADLSAWIYLRACQCAAYVGKGTTIYYNDKPCRTGSVMALAKMYTLLSAPNSTIHTATIKADAKPYSLHPLQVAAVVSPKFKKFEHVSVINGVNCVKGEHVTFLKKTINEMVVKKFQQTIKDKNRKTTLRDSCSNIFIVIVGSIPGIEWTGQRKDELSIAENVFKTHYSIPSSFLTSMTKSIVDILLQSISKKDNHKQVDVDKYTRARNAGGKRAQDCMLLAAEGDSALSLLRTGLTLGKSNPSGPSFDFCGMISLGGVIMNACKKVTNITTDSGETIMVRNEQLTNNKVLQGIVQVLGLDFNCHYKTQEERAKLRYGCIVACVDQDLDGCGKILGLLLAYFHLFWPQLIIHGFVKRLLTPLIRVYEKGKTMPVEFYYEQEFDAWAKKQTSLANHTVKYYKGLAAHDTHEVKSMFKHFDNMVYTFTLDDSAKELFHIYFGGESELRKRELCTGVVPLTETQTQSIHSVRRIPCSLHLQVDTKAYKLDAIERQIPNFLDGMTRARRKILAGGVKCFASNNRERKVFQFGGYVADHMFYHHGDMSLNTSIIKAAQYYPGSSHLYPVFIGIGSFGSRHLGGKDAGSPRYISVQLASEFIKTMFPAEDSWLLPYVFEDGQRAEPEYYVPVLPLAIMEYGANPSEGWKYTTWARQLEDILALVRAYVDKDNPKHELLHYAIKHKITILPLRPSNYNFKGHLKRFGQYYYSYGTYVISEQRNIITITELPLRVPTVAYIESIKKSSNRMTFIEEIIDYSSSETIEILVKLKPNSLNRIVEEFKETEEQDSIENFLRLRNCLHSHLNFVKPKGGIIEFNTYYEILYAWLPYRRELYQKRLMREHAVLKLRIIMETAIVRYINESAELNLSHYEDEKEASRILSEHGFPPLNHTLIISPEFASIEELNQKALQGCYTYILSLQARELLIAAKTRRVEKIKKMQARLDKVEQLLQESPFPGASVWLEEIDAVEKAIIKGRNTQWKFH

SEQ ID NO: 371 - protein, 359 aa, African swine fever virus
MEKIFQNVEIKPFLIDFSNLFIKNAAKKLFQLEEQLPLVPVNVVMDFKGISRAAVHGLSRVLQDEIPNYMLDIKPGGYKIEDSTDLFMTEQFIRNRINFIPIYAKNETLVFALRSLNNSCEVKTIYSRDLIQVAGPKLKYPIFNPTFEIGFLQPGKSLIIEDIYIKKGIGRKHAAFNLAVKTHFSHLDIEQYPTDKKEYMALSGYKQSSMTSDPRHHRLGLCFPAVPLPHINQAVRTYLKNACRIIIGRIQSIQKIYENFEEPQPELVLFSMDEEKTKAIITIKDETHTIGNLLKTYIYEMIPDISFVGYQCVPHKQEMVLTIIHKASQEDLITLLEKSIQNIIQTFQILEKNVDELIA

SEQ ID NO: 372 - protein, 171 aa, African swine fever virus
MVVYDLLVSLSKESIDVLRFVEANLAAFNQQYIFFNIQRKNSITTPLLITPQQEKISQIVEFLMDEYNKNNRRPSGPPREQPMHPLLPYQQSSDEQPMMPYQQPPGNDDQPYEQIYHKKHASQQVNTELNDYYQHILALGDEDKGMDSMLKLPEKAKRDSDDEDDMFSIKN

SEQ ID NO: 373 - protein, 124 aa, African swine fever virus
MNLEYVQVVQKFNQVLLELTKKVCTVVGGSKPTYWYHHIRRVCSECPSMPMSMIGPYLNVYKAQILTRDKNFFMNFDPAHNEYTFIIQKLKEAARNMPEDELEQYWVKLLFLLKSYIKCKPFIN

SEQ ID NO: 374 - protein, 339 aa, African swine fever virus
MAGRVKIKQKELIDSTVKNKNVMNLFHEIIGSKGNINFSVVWPKFKKIKQSVYDYISTLSVLEKANVMQNFEADKKLLELFVQKLWAAYEGYFKYPEIEKYEVEGQVNFNLVPQCVLEKFSQLYRIRINSELVTLILNSCAFMSKYNDYILKKDPYILTITPGLCFSPIPNFEDLNFKHLYNSDKNSQHDKEFIMFILYKLYTAALGVYNAISIPDIDVEDLENIILSSVSQIKKQIPRCKDAFNKIESSVHLLRKNFNTYYSDYVGSGYNPTIIMEQYIKDISQDSKNISPRISYQFRTIIKYYRDMIATRHQTMDPQVLNLVKHVEKKLDMLDREKN

SEQ ID NO: 375 - protein, 108 aa, African swine fever virus
MVNLFPVFTLIVIITILITTRELSTTMLIVSLVTDYIIINTQYTEQQHENNTFFMPQKNSFNESYNKDKKSNIHIPYQWLAPELKEAESKYWWGNYDPHSEPVLAGAS

SEQ ID NO: 376 - protein, 233 aa, African swine fever virus
MILIASPFSLAHLEYLHTWHVTIKNIAQQHGLDIKVAIVVSTSHLNNFLPISGALNIECITFPSCGIKEIDLLWARIKLFQHYCAIGARLLWLVSADIRPPVSAWPAIADSLKKGADAVVIPYPSRWNNLIPTVIKEIVVHQKKCLVAVDARHLDTDTQIVGAGMGCIVLTLKALMVRLSIGKQPVKILWPDLHGTAEGIPLEGVEVGWFLNAYAHKLNIRCLGADHIAQHLT

SEQ ID NO: 377 - protein, 241 aa, African swine fever virus
MAANIIATRAVPKMASKKEHQYCLLDSQEKRHGHYPFSFELKPYGQTGANIIGVQGSLTHVIKMTVFPFMIPFPLQKTHIDDFIGGRIYLFFKELDMQAVSDVNGMQYHFEFKVVPVSPNQVELLPVNNKYKFTYAIPVVQYLTPIFYDLSGPLDFPLDTLSVHVDILSNHIQLPIQNHNLTTGDRVFISGYKHLQTIELCKNNKIFIKNIPPLSSEKIKLYILKNRIRIPLYFKSLKTSK

SEQ ID NO: 378 - protein, 298 aa, African swine fever virus
MSRPEQQLKKMLKNPQAQYAFYPTAKVERISTTQHMYFIATRPMFEGGRNNVFLGHQVGQPIIFKYVSKKEIPGNEVIVLKALQDTPGVIKLIEYTENAMYHILIIEYIPNSVDLLHYHYFKKLEETEAKKIIFQLILIIQNIYEKGFIHGDIKDENLIIDINQKIIKVIDFGSAVRLDETRPQYNMFGTWEYVCPEFYYYGYYYQLPLTVWTIGMVAVNLFRFRAENFYLNDILKRENYIPENISETGKQFITECLTINENKRLSFKSLVSHPWFKGLKKEIQPISELGVDYKNVIT

SEQ ID NO: 379 - protein, 706 aa, African swine fever virus
MSCVHNNTSFPVQIEAYLKEVYEKYKELQESKDTSLTARFARALKYYQFLIYTAFSDPKFGIGQGENTRGLLIYHQMGMGKTILSLSLAISLSHIYNPILIAPKSLHSNFQQSLLKLIKLLYPETTDHSKELQKISRRFRFVSLDAYNMGQQIIKAGGSLNGCLLIVDEAHNLFRGIINSANDKTNARQLYNNIMQAKNIRILFLTGTPCSKDPFEMVPCFNMLSGRILLPLHYERFYTAYVNKTTNSPLNADKLLNRLVGMISYAGNQNELNKLFPTELPLIIEKVEMSPEQYRQYLLARDVENAEKHASSGMYEKINAAALCLPGSEQESGSSYYVRSRMISIFASEMLTVKEDEKLSEAVQQLPKEAFTENSSPKIVRMLKNIKTSPGPVLIYSQFVELGLHVVARFLEIEGYQCLQPLKVLEEGHNTILLHKDGKDLMVKNFAEDGPTHTLVLSSKITRFTLITGKILSKERDMIQQLWNSPLNIHGEVIKILLVSKTGAEGLDLKYGRQVHILEPYWDKAREDQVKARIIRIGSHDALPPEEKTVQPFLYIAVANQKMFYSIPEGSQEQKTIDERFHERGLEKSHLNSAFRDLLKRAAIECAFNGESGCLMCQPTNALLFHENFERDLRLPNPCQPLVKAEVKAYSISYEGKQFFYQKNKDVGLGYTFYEYNPIIKAYIEIKPSNPLYIKLIKHVQAGTTA

SEQ ID NO: 380 - protein, 509 aa, African swine fever virus
MEAIISFAGIGINYKKLQSKLQHDFGRVLKALTVTARALPGQPKHIAIRQETAFTLQGEYIYFPILLQKQFEMFNMVYTTRPVSLRALPCVETEFPLFNYQQEMVDKIHKKLLSPYGRFYLHLNTGLGKTRIAISIIQKLLYPTLVIVPTKAIQIQWIDELTLLLPHLRVAAYNNAACKKKDMTSKEYDVIVGIINTLRKKPEQFFEPFGLVVLDEAHELHSPENYKIFWKIQLSRILGLSATPLDRPDGMDKIIIHHLGQPQRTVSPTTTFSGYVREIEYQGHPDFVSPVYINEKVSAIATIDKLLQDPSRIQLVVNEAKRLYSLHTAEPHKWGTDEPYGIIIFVEFRKLLEIFYQALSKEFKDVQIIVPEVALLCGGVSNTALSQAHSASIILLTYGYGRRGISFKHMTSIIMATPRRNNMEQILGRITRQGSDEKKVRIVVDIKDTLSPLSSQVYDRHRIYKKKGYPIFKCSASYQQPYSSNEVLIWDPYNESCLACTTTPPSPSK

SEQ ID NO: 381 - protein, 383 aa, African swine fever virus
MASILTLDGLYAEVPKFLPEALREGCAGKNPLSFYIQQILNLMGCDGNEYHVLFTSSSEEANTHMIMAAVRRHLLRTQQRPHVIIGAAEPPSVTECVKALAQEKRCVYTIIPLKNFEIDPVAVYDAIQSNTCLACISGTNAVVKTFNKLQDISNVLKGIPLHSEVSDLVYQGCIQQNPPADSFSINSLYGFLGVGVLGMKKKVMQGLGPLIFGGGLRGGSPNIPGIHAMYKTLTQQRPSMKKNKYNTYAVHENFKKHQHVYLPIGGVSAEDTSAENISTKDMPVEGPKGLPGYILFSVGRRAEELQKKIFTKFNIKVGRVVDLQEILFRIKIPQKYWETLLFIQLRDNLTKEDIKRVMVVLMHLDTITPRGSLPPPSHSSSFS

SEQ ID NO: 382 - protein, 184 aa, African swine fever virus
MKTFITCTSVKNYFRQHLKTNQRISSELISYVCTILNHICHQYLQNPQAQEEEWFALIKELPIIKDGLSKEERFFSSGVKHFLHEYKITPENQEKFQKMLNAITEQLMSRLCKVFSIMIQRQGFLKTQTLMYSHLFTILSILMVADNLYGEQDPTEFFSLIIEQTKTIKKKKKSGSEEEESHEE

SEQ ID NO: 383 - protein, 184 aa, African swine fever virus
MDSEFFQPVYPRHYGECLSPVTTPSFFSTHMYTILIAIVVLVIIIIVLIYLFSSRKKKAAAIEEEDIQFINPYQDQQWVEVTPQPGTSKPAGATTASVGKPVTGRPATNRPATNKPVTDNPVTDRLVMATGGPAAAPAAASAPAHPAEPYTTVTTQNTASQTMSAIENLRQRNTYTHKDLENSL

SEQ ID NO: 384 - protein, 423 aa, African swine fever virus
MLWRNEITEFMDQLSKYSQEILKTFKQLRPSEYKQYNEFLTQVTPLLQKTPEKIPELVDHIFNYLDNVEKICELLVNASSIIISSKIREQVKHGMSFSYKADLDSLADILSQKQYVLMHLSKNIAAEYFNTCLNQGKSKLDLKAASVFYSSRSRTASSAELYRKMLYAYGSPQEINYYTEKARNKTLDVEESDSMAIIERTARHNLSLMHPLEAMGLTFGATNTDADPEDLKDKTVINLTLPQATESITYHLKSLMQLKKVSTASGLNTNILKAFDNIISTPVKKNKMASKLAPGMDVVFTSDNGKTFFTKNILSKNMLAGPKERVFAYNNLISNLNNSCFIQNHNDFLRQQDSWPFYDAHNFTNKFLMQPIFSGQTRPRLQGAMEAAHVETHLTAFLQSIQPSRPQDPSVLASPKLSALILN

SEQ ID NO: 385 - protein, 301 aa, African swine fever virus
MSEDIRRGPGRPPKKRVVPNFERKGILEKPVRPQSRLEFSYDNPLIFKNLFIYFKNLKSKNILVRCTPTEITFFSRDQSQASFVIATIDGKNVNHYYASDVFWLGINRELVEKMFNSIDRSFLKITIVHRYDKPETLFFIFTDFDIDKECTYQITVSEPELDMDLIEMEKSISEERLKNYPLRWEFTSKQLKKTFSDLSNYTELVTIEKLGGDTPLHLYFQKFNSISYHEMYKSSNKINLTSTIPKSQVFQINVKIAHIKSLASAMVTDKIRILCEENGNLIFQSEMDALMLNTITLNTTI

SEQ ID NO: 386 - protein, 146 aa, African swine fever virus
MGGTTDFVLSITIVLVILIIIAFIWYNFTGWSPFKYSKGNTVTFKTPDESSIAYMRFRNCVFTFTDPKGSLHSIDVTEVLNNMAKGFRDAQNPPSSFTLGGHCQAPLNAFSFVLPGVNDRATVATADEAKKWENCDATLTGLQRII

SEQ ID NO: 387 - protein, 199 aa, African swine fever virus
MSCMPVSTKCNDIWVDFSCTGPSISELQKKEPKAWAAILRSHTNQQTAEDDNIIGSICDKQGLCSKDEYAYSQYCACVNSGTLWAECAFAPCNGNKNAYKTTEQRNILTNKQCPSGLTICQNIAEYGGSGNISDLYQNFNCNSVINTFLINVMNHPFLTLILIILILIIIYRLMSSSGGKHNDDKLPPPSLIFSNLNNF

SEQ ID NO: 388 - protein, 165 aa, African swine fever virus
MATNFFIQPITEEAEAYYPPSVITNKRKDLGVDVYCCSDLVLQPGLNIVRLHIKVACEHMGKKCGFKIMARSSMCTHERLLILANGIGLIDPGYVGELMLKIINLGDTPVQIWAKECLVQLVAQGDHVPDHINILKRNQIFPLFAPTPRGEGRFGSTGEAGIMRT

SEQ ID NO: 389 - protein, 248 aa, African swine fever virus
MGGSTSKNSFKNTTNIISNSIFNQMQSCISMLDGKNYIGVFGDGNILNHVFQDLNLSLNTSCVQKHVNEENFITNLSNQITQNLKDQEVALTQWMDAGTHDQKTDIEENIKVNLTTTLIQNCVSSLSGMNVLVVKGNGNIVENATQKQSQQIISNCLQGSKQAIDTTTGITNTVNQYSHYTSKNFFDFIADAISAVFKNIMVAAVVIVLIIVGFIAVFYFLHSRHRHEEEEEAEPLISNKVLKNAAVS

SEQ ID NO: 390 - protein, 122 aa, African swine fever virus
MADFNSPIQYLKEDSRDRTSIGSLEYDENADTMIPSFAAGLEEFEPIPDYDPTTSTSLYSQLTHNMEKIAEEEDSNFLHDTREFTSLVPDEADNKPEDDEESGAKPKKKKHLFPKLSSHKSK

SEQ ID NO: 391 - protein, 296 aa, African swine fever virus
MFGAFVSHRLWSDSGCTTTCITNSIANYVAFGEQIGFPFKSAQVFIAGPRKAVINIQEDDKVELLKMIVKHNLWVVAHGTYLDVPWSRKSAFVTHFIQQELLICKEVGIKGLVLHLGAVEPELIMEGLKKIKPVEGVVIYLETPHNKHHTYKYSTIEQIKELFLRIRNTRLKQIGLCIDTAHIWSSGVNISSYNDAGQWLRSLENIHSVIPPSHIMFHLNDAATECGSGIDRHASLFEGMIWKSYSHKIKQSGLYCFVEYVTRHQCPAILERNLGSSMQLQTALTAEFTTLKSLLK

SEQ ID NO: 392 - protein, 111 aa, African swine fever virus
MSFSECPLVISACKKFLQKRITIENEALINALITALAQTSTLNDLCLLPIQTYLLSYKNAFEWIHFVCIAITTILDNKYNWKDCTVDINYIFLHVTYIYNIKTKEYLDYCS

SEQ ID NO: 393 - protein, 50 aa, African swine fever virus
MHISIITRYTLKYIYMHLTHNHILFTYIMRIYLIKHNHMLFTTHVYTYIM

SEQ ID NO: 394 - protein, 279 aa, African swine fever virus
MLLVLIDVDGFMGQLYNENGTQTILIPREVVIFYWEKNTPSKILQLFFHGGIDPIFEKINQRSFSFQSRHIHHFTLDESPLPNSIALPTDTLQAFKAGKKMIFQHLVKITKDHEQILLLHKGGPEGEWIRSFNIPNATVQNLNDLCCPSVEKLVLKKRDYISSSIGCPKHIQGSNHCPVFECHVLFKWIQENTSIVQGVLERPSLPYEKADLFIEHRINMVDNHPFKKDSIKQNQKKRTGSQRNLSNMGYMLTMASLARFIINTASFNKCIYPLSQDIR

SEQ ID NO: 395 - protein, 226 aa, African swine fever virus
MKMETFLVCLFHNADGLHQQIQEILYLLRMHIYETNLYLKQELSRLIYPNRQLSFVLLMPLSLLRNWDDIEYLTDVVDDKQTLHYAANLLTNYVLHLSMFQKLTKPYFLLAVKRVSEKLNKKQRHSFYEVLVTSETLNNYENLSKNILNTLMFAVRYVFKPTPNYSEILAELEKKNKIHHIIFNMVITDFAQIREQQMDKHLCETNNELRQECKETIFDLKVVGNV

SEQ ID NO: 396 - protein, 243 aa, African swine fever virus
MKMHIARDSIVFLLNKYLQNTILTNKIEQECFLQADTPKKYLQYIKPFLINCMTKNITTDLVMKDSKRLEPYIILEMRDIIQMMFFRTLQKHMFFKEHTDLCTEYAQKIEASCYHYTYQQQEKTFLEEYSTRCGTINHIINCEKKSHQQQDNDALNKLISGELKPEAIGSMTFAELCPSAALKEKTEITLRSQQKVAEKTSQLYKCPNCKQRMCTYREVQTRALDEPSTIFCTCKKCGHEFIG

SEQ ID NO: 397 - protein, 72 aa, African swine fever virus
METQKLISMVKEALEKYQYPLTAKNIKVVIQKEHNVVLPTGSINSILYSNSELFEKIDKTNTIYPPLWIRKN

SEQ ID NO: 398 - protein, 329 aa, African swine fever virus
MLRVFIFFVFLGSGLTGRIKPQVTCKYFISENNTWYKYNVTILNSSIVLPAYNTIPSNAAGISCTCHDIDYLQKNNISIHYNTSILKTFQDIRIIRCGMKNISEIAGGFGKELKFLDLRYNDLQVIDYNILRKLIRSNTPTYLYYNNLMCGKRNCPLYYFLLKQEQTYLKRLPQFFLRRINFSNNNTFLYHFLSCGNKPGHEFLEYQTKYCRTKFPEINITVNQLIAKKNTERYKSCYPLVFISILCSCISFLFLFICLLRSICKKYSCTKQDKSSHNYIPLIPSYTFSLKKHRHPETAVVEDHTTSANSPIVYIPTTEEKKVSCSRRK

SEQ ID NO: 399 - protein, 212 aa, African swine fever virus
MVSRFLIAEYRHLIENPSENFKISVNEKDMTEWDVILRGPPDTFYEGGLFKAKIAFPPEYPYAPPRLTFTSEMWHPNIYSDGKLCISILHGDNAEEQGMTWSPAQKIDTILLSVISLLNEPNPDSPANVDAAKSYRKLLYKEDLESYPMEVKRTVKKSLDECSPEDIEYFKNAASNVPPIPSDAYEDECEEMEDDTYILTYDDEDEEEEDDE

SEQ ID NO: 400 - protein, 66 aa, African swine fever virus
MWKVNDQGFLNISVTGTKFNLIAITGKLGFYTDPPSHLIIMPLKFFPVHKFSKNEPNKKQKRFIYF

SEQ ID NO: 401 - protein, 27 aa, African swine fever virus
MYEIILAIIIILLTIIIFIFIKHPLNV

SEQ ID NO: 402 - protein, 202 aa, African swine fever virus
MLFRYLVWLFRFIEVKNVVSISLLVIGSNYLTTAISNNTSTTISPTTTSSNYLMTAISNNTSTTISPTTTSSNYLMTAIPNIISDKEDDIHFSTDKTVFDRLSPITLYRAIRSTLNDTSTKTMTDHILTRPYRPTTVIFHSDTPQPVKNATQGNIVKKIYRQVLTFFIQPNPLFPCFKNHEVFLNLANILNTILCIILIKNV

SEQ ID NO: 403 - protein, 238 aa, African swine fever virus
MARGQNIRKRTFSDMDTPSDKNIGIHTNSLPKNNLYRRILFKGKISNYSISKDSLAKDHSSNHSISKNGLIGKKRPAPLDISFQNMNSSISSSTQKKTRILDEEIKDQSLSNENDRDSPVIVDITLKPSYMSKTSRITEIIHKMKELNMNRIEDGSSFNKKRSEHDDKNILLHTMEMEEEDCEIEEDIAIDSPYLNTSLSEDDTDSIVGTDYSEEEKETISETESSSDDESYSLYDSF

SEQ ID NO: 404 - protein, 309 aa, African swine fever virus
MLSLQTIAKMAVATNTYSKYHYPILKVFGLWWKNNTLNGPIKICNHCNNIMVGEYPMCYNHGMSLDIALIRAVKERNISLVQLFTEWGGNIDYGALCANTPSMQRLCKSLGAKPPKGRMYMDALIHLSDTLNDNDLIRGYEIFDDNSVLDCVNLIRLKIMLTLKARIPLMEQLDQIALKQLLQRYWYAMAVQHNLTIAIHYFDNHIPNIKPFSLRCALYFNDPFKIHDACRTVNMDPNEMMNIACQQDLNFQSIYYCYLLGADINQAMLMSLKYGHLSNMWFCIDLGADAFKEAGALAEKKIKECYNTY

SEQ ID NO: 405 - protein, 48 aa, African swine fever virus
VLQHILGLNIFKRELIPPCKDPDPYQIQILLKNYILKNVSTVFTYYCQ

SEQ ID NO: 406 - protein, 542 aa, African swine fever virus
MFSLQKKALQHIYMTPENASQLTKDLLQHLGLYWNGPIVKMDTVIHLHNNIFSNRSVLKYALAKQANISIIETLVLWVEPEYALAQALKHNRKDVLECIFSYHLTTPKYHHIMHLTSSQELFEFFHLFICKSKNYNARMECLLYAATLYNFPNILEKNREYIIRHSIGNSLFAIACKERHIHLIAWFVTAGVLDTYDDSTLFNTAFRLGDYSLLEVACDLPIIYPDYLIISMMQTAIQKNYFRFFKKLLTHFNIYRPIIITDAAYYNRRKILLLLLNQNVFNNFAILCALSAAIKGHASKKTLNLLISQLDSQMTVIDSVYYSIIKYNNIDCILLLMQIKTFRLETLVSIAVHGDNIDIIAACKAFLPKDTLYHLVLKMAIISRNHKLFKLYTEKENPMYIFTTMKAIISNLVNYTVVQAVAIEYLRKFHQEKQLPIVPLLMVLAEHNYITKFKKACYAANMSDQKVKRALIKCLFIASQKNYCQIFKYCFGSLLKVLSKHERVKFFNSVVFAKKLASYYDHQNMIHLIDSLIERFRYLIKD

SEQ ID NO: 407 - protein, 141 aa, African swine fever virus
MGNKESKYLEMCSEEAWLNIPNIFKCIFIRKLFYNKWLKYQEKKLKKSLKLLSFYHPKKDFVGIRDMLQMAPGGSYFITDNMTEEFLMLVVKHPEDGSAEFTKLCLKGSCIVIDGYYYDNLHIFISETPDIYKYPLIRYDR

SEQ ID NO: 408 - protein, 102 aa, African swine fever virus
MGNHPIKQDMKTCDYYHGEKKLKYMRRMLYNEPLGTYAVSSLFGCDMIVLTWNCTISGRTLHRRIHTRFGQYYHNNCYYTKIDDIIGDYPDTFYRPLYRYKP

SEQ ID NO: 409 - protein, 103 aa, African swine fever virus
MGNRLIKKDLKKCEYYYGEQQNLKQIWRLLFNEPLGTYVVSSFLKKNYVVISFSCPTNTRIMHLRINICYDLYCINGEYYEKIDDFIRLYPHIFYRPLYRYKS

SEQ ID NO: 410 - protein, 45 aa, African swine fever virus
MYFQQTRSILIKNDAVFILNLGLKFKEVFINYNHGNFFSNCLCKK

SEQ ID NO: 411 - protein, 96 aa, African swine fever virus
MGTFSVTASAKSDDAVCKYLEEPIDENYRNILRNEHVKKNLNEALNRHITTYNPVVDWCNNYSTFSSQDFDEYKIYIHSDLMDGRPRPKKTWCVIM

SEQ ID NO: 412 - protein, 170 aa, African swine fever virus
MFYPVVQVLIGIILVIILILGFYHLKHKPPKKKCKTDTDCKDKGHHCVRGTCTDKSCLEAVKQDIKDIKLDPTIRSCDYAPGFYRFNATTADLQSPFGKTRIDLGRIWTTWSKEDECCQSLCLQHKGCIGWEFDEVSLGGTGECYYYLNPHLALKNSNNNTVMGIARNVL

SEQ ID NO: 413 - protein, 93 aa, African swine fever virus
MDFFLLKKIFFFVDNRMLEPMLVMAPIPLVLIFLYSYFKIKLHKLITIALFLGCLFFILRDFCFPPMLWTQLHNITSSINILGNKSFQVQCNK

SEQ ID NO: 414 - protein, 237 aa, African swine fever virus
MLEIVLATLLGDLQRLRVLTPQQRAVAFFRANTKELEDFLCSDGQSEEVLSGPLLNRLLEPSGPLDILTGYHLFRQNPKAGQLRGLEVKMLERLYDANIYNILSRLRPEKVRNKAIELYWVFRAIHICHAPLVLDIVRYEEPDFAELAFICAAYFGEPQVMYLLYKYMPLTRAVLTDAIRISLESNNQVGICYAYLMGGSLKGLVSAPLRKRLRAKLRSQRKKKDVLSPHDFLLLLQ

SEQ ID NO: 415 - protein, 70 aa, African swine fever virus
MGRRRKKRTNDAKHVHFATAVEVWEADDIERKGPWEQVAVDRFRFQRRIASVEELLSAVLLRQKKLLEQQ

SEQ ID NO: 416 - protein, 96 aa, African swine fever virus
MSTHDCSLKEKPVDMNDISEKSVVVDNAPEKPAGANHIPEKSAREMTSSEWIAEYWKGIKRGNDVPCCCPRKMTSADKKFSVFGKGSLMRSIQKNN

SEQ ID NO: 417 - protein, 43 aa, African swine fever virus
MDIWYLKYVIAYILLLTMLVIGLIYRIIVLIYRSIQAQKKCCL

SEQ ID NO: 418 - protein, 43 aa, African swine fever virus
MVAFKNIKKTLSFRQQQIVCRRPQTIFRVFCTIKYFFWSGLLL

SEQ ID NO: 419 - protein, 356 aa, African swine fever virus
MSTPLSLQTLVKKVLATQHISKEHYFILKYCGLWWHEAPITICIDEDSQILIKSASFKEGLSLDIALMKVVQENNHDLIELFTKWGADINSSLVTVNTEYTRNLCQKLGAKEALNERDILQIFYKTRHLKTSSNIILYNELFSNNLLFQNIERLSLIVYRGLKNLSINFILDDISFSEMLTRYWYSMAILYNLTEAIQYFYQRYRHFKDWRLICGLSFNNLSDLHEVYNLEKTDIDIDEMMKLTCSTYDGNYSTIYYCFMLGADINRAMLTSVINFHIGNLFLCIDLGADAFEDSMELAKQKNNNILVEILSFKNYYSSNTSLLSIKTTDPEKINALLDEEKYESKNMLMYEELSH

SEQ ID NO: 420 - protein, 64 aa, African swine fever virus
MIKKKNYFFGQHLFVRIVDKSAGNNNIYNFFLGEKNNYVTSYIPIGDLSPSESSVIKNNFVSMR

SEQ ID NO: 421 - protein, 48 aa, African swine fever virus
MNIYLVWFLYILLGNLILAVIYCVIDEVVCDNIHIKKNVAAPEMPRRF

SEQ ID NO: 422 - protein, 54 aa, African swine fever virus
MSLWPPQKKVFTVGFITGGVTPVMVNFVWPAAQPQKKINYNRKKKYFRPRRFKK

SEQ ID NO: 423 - DNA, 32767 bp, African swine fever virus
gaatataccatattattgctattgccatcaatgagaatgccacgtaggcataggtcatcctatggccggaccaatccatggctgcacttaaaaatatcaaaaaagtttaagttttgggccggcgttaaaatttaaaccttttctggttgatctttagccatgtatagctgcgatgtttggtgccttatctacatgctattggcattcctgatattcgcactaaagtgctatgttacaaccgtcttatgcgtgatttttatccaccttattggccgaagggccgccttgtatttcctgttaggtggtttggccgtattctactggtggcaagcagctatcaataaaatttaatggctctcacttaagatccttgctgtaagcgggcgtttacatactttgatcaagaaaaaaattatttttggacccccccccagttttatcaaaaatcatataataaagtggcgacaatcaacatattaatcaaccacagcattttatgatgtgttaatcaacatataccatattaatcaaccacagcattttatgatgcgtcaatcaacatattattacggagagcgtcaatcaatataatattgagaacagcgacttgataccgtgtatggtggtggcggcggcatgttgtttgtaacagcatttttcatcattcgaagcttacaaaagatatgtataagatagcatattaatgttattaacagtaatatcaataaggcgtagctatagatcttcactttggtagaccaataatccatggttgcgcttaaaaataccaaaaaaaacattaagttttggagggtaagattggtttttcaccattggtaaagattattattctaaatgtttaccccatagatgtgaaacaatgattcttcatatattaacatattttttgacttatacttttcttcatctagtaaggcgttaattttttccggatctgtcgtttttattgataaaagagaagagtctggactgtaatttttaaataataagatatttattaatatccaattattcgtttggctcgctatttccatgctctcttcgaaagcatcagctcctaaatctatacaaaggaataagttaccttcacaaaaattcattaccgaggtaatcattgcccgattaatgtcagcccccaacataaaacaataatatatagttgtataattacaatcatacatacaggccaactgcatcatttcatcaatgtctatatttgtcttctctttgttataaatttcatgaaggtcaaagacgttgttataagcaaccccacatattaaccgccaatctttaaaatgactatatcgttgataaaaatattggatggcttcagtaagcttatatagtatcgccatactataccaatacctagttagcatttcgttgaatgaaatattatccaatgtaaagttaattgataatgtatctagttcaccaaaaattcttaatttcagttgagcattatttaggaaaaggggattatcagataataattcatggcatagaataatattactgctagttttaacatactgtacattataaaatatttctaaaattttattttcactcaaagctttttcctcgcacctaactttggcataggtcctggtgcactccatattgacagtaaccaacccaaagctgatgtctgcaccccattcggtaaacagctctattaaaccatgattgttttcctgtacagccttcattaatgcaacatttaatgttaaaccatgtttaaaacttgctgtttttattaatatttgttcatctatacaagtatgataaatcgtaattggggcttcatgccaccacaaaccacaacgctctaaaatacaataatcatcttttaacacaggctgtgtagctagtacttttttagtaagtgcttgtaaagtagatggcatcttctatctgcaaaataattatttccgaaaaaaaaatcaaattaaaatactaaattctatttttttttttaataaagcctgtaaattatataataaatctcgcccaccgtattatttccggacacaactttttatacctcattatatttttagatctatagttttttaacaaggcattaattttttctggatctgtcgtttttaaagataaaagagagacgtttgaactataataatctttaaatgataatatttctactaatatatcatgattcttttgttttgctaattctaagctctcttcgaaagcattagctcctaaatctatacaaaagaacaagttattcatataaaagttttttaccgaggtaaccattgcccgattgatgtcagcccccaatacaaaacaatagtaaatggttaaaaaattgctatctctcatacaggccagatatatcatttcatcaatattcatatcaaccttttttatatgatacatttcatgaagatcagacacgttattaaaagaaagcccacatattagccgccaatctttaaaatgactatatcgttgataaaaatattggatggcttcagtaagcttacatagtatcgctatactataccaatatctagttagcatttcgttgaatgttatttcattcaatataaagttgatcgatatcttctctagaaaacaacaaattattacttttaattcctctatattctggaaaaggggattattagataacaatttatggcataaaataatattactactagttttaatacgatgtattttataaaatatttgtacaatatccatttcattcaaaatttttgcgcctaactcccggcagaaattccaagtatgctccgtattgacagtgactaagctagagttgatgtctgcaccccattcagtaaacaactctattagatcatagttgttttcctgcacagttttcattaatgcgagatttaactctaaaccatctttaaaaattgctgattttatcatcaattgattatcctcattagtagaaagcataattggagctccatgccaccacaaaccacaatatttcaaaataaagtagtgttctttagatatgtgctgtgtggccagtatttttttagcaagagcctgcagagaaattggagtagacatatttttttttgcaaaatggtttaagtttttcaagaatacagattggataaattaggttgttgacttagttacaggaggtattaaatattatgtagacataaaaatgagatcctccaaaaaaataaacaacaaaaaaaatatgtttaatattaaaatgacaatttctacattgcttattgctcttattatactacttattattattttagtagtgtttttatactataagaaacaacaaccaccgaaaaaggtctgtaaagtagataaagattgtggtagtggagagcattgtgttcgtggatcatgtagctcattgagctgcttagatgccgtaaaaatggacaaacgaaatattaagatagattctaagatttcctcatgcgaattcactcccaatttttaccgttttacggatactgctgctgatgagcagcaagaatttggaaaaacacggcatcctataaaaataactccatctccaagtgaatcccatagcccccaagaggtgtgtgaaaaatattgttcatggggaaccgatgactgtacaggttgggaatatgttggtgatgaaaaggagggaacatgttatgtatataataatccacatcacccggttcttaaatatggtaaggatcacatcatagccttacctagaaatcataaacatgcataaataaatacattaggctcatcgtatctttttaaaatccataaatattcgtttgatatatgctgaaatttttataaaaaaaataactatttcctataaatcatctagaaatagtcctcgttttgatcggtttatatcttataatattgtgcatcgatgcacaactgctttttttggtccttctggaacatcattatattttctttcattaatataccattcagatgtaaacgttgaataatttttatggcaacaatctaccattgaattatatttagtaacatctaatacatcgtttgttttatcaggctcagctctataatcttgataatttttgttatcagcttctaaagctccatcattatttttcaaagaagtatccataattatgtttggtaaaaatactttaagttttaatgtgatatttaaaatggttgttatataaatttaccgcttacaggtaatctttattcagtgtcataaactatacttttgatgattcagtattttgtgaatcagtacatttattatcattaatatttttaggctgtttttccaatgttttattgttgcaatgagcctgctcctcctttgacgaggaagtgtctgttggagtcatctgtttaggaagagtatcatccatatctattatgaagaaaatatataaatattgatatacaatcaaaaatatttttgatcacgtctttgttatctatcgatattgttgataacgtcttgaataacctacatcatttttttacataaaaaaatagatataatttttattatatctcaattattttaaagataattatcaatacagcaaatatcataagctaacatatttttcgaataatagttttttagtaaagtattaatcttttcaggattggtttcttttgataataagataggattcgctttataaatttttaaagataatatattcacaatgatagaataaccgtatatatctgctaatgtcttactgtgttcaataacattagcccctaaatccatacaaaagaacatattttcaatacaaaagttttttaccgagattaacattgctcgattagcgttggctcccaatgcaaaacagtagtaaatggtcaaaaaattattatcgcgcatacaggccagctccatcattttattaatactcatatgaattttcgttgtgttacatatttcatgaaggtcaaacacattgttgaaagaaagtgcacaaattaatcgccattcatcaaaatgcctgtattcttgacaaaaatattgaatagcttctttaagattatattttaccgctatgccataccaatatttggttagcatctcactaaatgagatctcatttaacatagaatttgttgttaaatccttcaactcccaataaatgatcatccttaaatccaccatgtttacattttgtaaaaaagggttattagaaaataattcatgacacaaaatgacattactacttgttattttacactttgtttcaaagaaaaatcgtaaaatttcacttgtctcaagctcttctttagctcccaattttcggcataggtttcgagtatgctcgttattaataaaaagtaacccataattaatatttgcaccccattcagtaaacaacatgattagatcatcattgttttccttaactgccaataccaatgcagtattaagccttataccctctttaaagcataatgtccttatcattatttgattatcatcatctatatacattgagataggagcttcatgccaccataaaccataacgctctaaaatataataatcatctttagatacgtgttgcgtggccaatgcccttttagcaagtgcttgtaaagtcgatggctgcatgtttattctgttaaaaaaaatcaaattatcgggtaaacataaggatcaacccgtagttaatatttgcagtagtattttttaacaatgaattataataaaaaaataattcattactatctattataaaacccatctttaactttaaagaagaactagatcatcttttttttgttgtgtcagaacttcttcaatttattacccacattttatctaaaaaaataaaaactacatcatatcttgtttcttcatcaaattatcataccatttatagggtgtaggttgggaacattccatcatgtggtaatcagggtatttatatattttttgatagtaacatctatttggcagatgtattgtccaacaatcatgtctaataaaatcattttcacctatgggggaatcatcttaaaaaccttattcctacagattccattttgacagtcccagcaaaagtcacaatattttccatgagtacaccaatgttcaagctctctttcgggaggaatgctgccaattttatgttttttagcttctaactctctgtacaacatcagttgggaaagcagaaagaagattaccaggagaaccattaaatatataatagtctgcaaactacgtttgcgaatgtaatttgcaactaaaacacaacccacaaggtaaaatccataagttaataacttttgccattttcgtatgacagcctcgtgccattcatggttgtgttgtgggcattctgttcggtaaacttcatgaggctttatagaagttacatagtaggtacagaattcattgtgacgaaaaacactgcagttagctatgtagtcattttcaagaatgggagaatggttttcaaagaccttattcttacagatgccatcttgacagtcccaacagaacctacaatgatttgcataggtgcaccagtattcaagctccttttcaggaggggttcttgttagatccaggagctctagctcatatgtataaagaagagttggaatggatagtaaagtaaatatttgcagaccaagcatggctacttgtgaacaagtggctgctcgtcaacaaatagctgtttatcagcaaatagctgtttatcagcaacaactaattatcagcaaatgctgcttgtgggtaagccaataaataggccatacccttgaaaggagaattcagtttgataaaaaaaataacgagttttctaataacccggtcaagcatttaataaatgaatagcatcacacgtctgcatcgtgcattctgcctggaaaatgggcccatctctaatatatttacactgacggtgaatcatacagtgttccatgggatagctatgctcctgtacaggaggcatatcttttagaactttattcttacaaagaccatcttgacaagcccagcaaaaccgacaatttttcacatattgacaccagtatctaagctcctcttccaggggattgtcggtcgaaaacccctgtagactagctaggccagctagcagcaagccgaggtaactaaagaacctcattgtagtgttatattacgaaaaaacatgttaaaatttggaaaaaaaagccctttttatagatctggaaaaaaattttcacaaatctaattaaaagccttacagatcatccttttcataaattttcattaacaattggtgggggcggttgtgaggtactggatcagaacaatccataacatggtaatgtccatttccttcaccatatgtacactggttataccagcgagaaacctcacaagatgtcaaataactgttctcaacaatcaatggcatgctcttattcaccttgttcttgcaaattccatgtgcacattcccagcaaaacttgcagttttccatgtaagtacaccagtatccaagttcttcttgtggaggattatccgttgaacgaagatgccctcctgcctgagtaggtagtcctaagacctgattggccagcaggccaagaatttccaagaagatcaccaacattgctacggctggctgaacagctggcagatagctagctaattagcaaaccaagtgactcgccctctctactcttaatatgagaatttaagattcggtccggcttttttcccatgttttacagggaaaaggtatttttagcctatgaatgtacatggttccgcacattaaaaaaaataaaagaaattatttaatattggctgttattttctttcaactagcaacaagccaggtaactaaagaacttcattgtagttttatattacggaaaaggttaaattttggacaaaaaaatcatatctaattaaaaatcctcacagatctttcttttcataaattttcattaacaattggtaggggcggttgtgaggtactggatcagaacaatccataacatggtaatgcccatttccttcaccatatgtacactggttataccagcgagaaacctcacatgttgtcaagtagctgttttcaataatcaatggcatgctattattcaccttgttcttgcaaattccatgtgcacattcccagcaaaacttgcacctttccatgtaagtgcaccagtatccaagttcttcttgtggaggattatccgttgaacgaagatgccctcctgcctgagtaggtagtcctacgacctgattggccagcaggccaagaattcccaagaagactaccaacattgctacggctggctgaacagctggcagatagctagctaattagcaaaccaagtgactcaccctctctactcttaatatgagaatttaagatccggtccgacatttttccgatattttacaagaaaaagatatttttagctacaaatacacttcatatatccctaaaaaaacaaaaatttatttaattttaactattattttctttccactctctctttaagattttgtaaggattccagggctttggttcagaacaggccattacatggtgaatcccctgtcctagatcatacatacatttatttagccagcgggaaactatacatgattgcacatactcattttcaagaattgttgtattctccaatttgccctcacaaaggccattttgacaattccagcaaaacttgcagttttctgtataagtgcaccagtattcaagttcttcttgtggaggattatccgttggatgaagttgtccagctggttgattaggtagccctaagacctggttgcaattcatggtatggtagatacccttatctaaatcatacatacatttatccagccaacgggaaaccagacatgatttcacatactcattcttgtaaattactgacccatctattttgtttatacaagtgccgtcttggcagtcccagcaaaattggcaactttccatgtaggcacaccagtattcgagttcttcctctggaggctcctctgttggacgaagttgtccaacgagctgacttgaaacctggctggccagaaggccaagaattcccaagaagatcaccaacattgctacggctggctgaacagctgactgaatagctagccaattagcaatccactgtacttttcataagatcatttaagattcggtcggcattttttcaatagtttgctaggaaaaaatttttaattttatagattcacactacttcattctcatgcttaggaaaaaaacaaactaaatcttacaatgtatctggatctaatgagaagctagaattcatcttttttcaaatcctttctgggatgttcattctttttccactccttccttgcaattttataaggattccagggctttgggtcagaacagttcatgctatggtaaatgtgctcctccacatcatatctacataggtcaccccagcgggaaacctcacaatattttacatagtcattctcaataatacttgtggagttgtttccccaaaccctgctggtacaaatcccatcttcacaatcccagcagaaccgacagctttccacataagtgcaccagtatccaagttcattctctgggggttcaaatgttagaggaagatgtccacctacccgagtagaagtggaggatgaaaccaggttgctactggccagcaggccaataattcccaggataatcaccagcattgtgctcaaccagcaacggctagcaacgactagcaactgactagcaatagctagaaatggctagcaatcagtagtagctaacgctctactctttataagaaaatttaaaattcgatcagatttttttagaattgagaatgagtaaaacgcttatattctttttctagctagaaaaaataagctagtttaagataggatttcccttactaacggtttaatttttagcaaaggtataggtaaaatacacttgtacttagctgcaaaaaaataagcttatggcgtataagccgccataagtttatttaattaaaatgttaaactctgtgataagactggaatcttaggcaggtttgatgtggagaacagcatgaaatacaagagtgcctgttacacgaataagttctctcaaaccggggatggtcatactcacatctatgaaatcctggtctaggagattcatttgatgcatgatggccgcacccacacttatgagacactgaagaactaaagggtttaattttgatctgaatggtactatataggatgatggcaatccatatcaagattagagcaatcaaaatcacctcctcaagaagcatgatgtagccttaaatcttagactgctttaaaccttaggccctcactatctttaatgaaggagtttaaattttgatccctttttcaagacccatttagaagaaaaaataaagtttatatcaatctaattcataagtcatctctttcataaatcttcatgtattctctatgtggataagtatgggatgttggatttgcgcagtccatttgatgatctgtatggtttttgggtccttcataataactacatataccattccagcgggaaaccgtgcaatttataatccagtcattttgatgaataactggccaatctgtttgaatcctgtttcggcagataccgtggacgcattcccagcaaaagtcacattggtttgcgtaagtgcaccaataaactagctcatgttcaggaggataacgggttggtagtaaatcttctaatttacgtataggagcggcttgaaggacaaccacccccagtagtactagaatcagtacctttatagtggccaccctacactagacctctaagttgaagacaaagaactaaaatttagagccgtttaattactactaataattatattttttattgtctacaataggattctattaaaaaataatgatttttaccaagaaatatttttataaaaaattaatatattttgtaataaactttatttccaatgactgttaaaataaggaaactatccttagttagtcgaggaagatggttaggttatttcgcaatccgataaaatgtttattttatcgtaggtctcgtaaaatccaggaaaaaaaattacggaagagtttaaaaaagctaaatttttaccaccctccagaagattgttgtcaaatatatcgtttgctagaaaatgttcctggaggaacttactttattacagaaaatatgacgaatgatttaattatggtcgtaaaggattcggtggataaaaaaattaaaagcattaaattatatcttcatggaagttatattaagattcatcagcactattatattaatatttatatgtatcttatgagatatacccaaatttataaatatcccttaatttgttttaacaaatattataacatctaagtaaatattcttggaatggattttcttatagaatggttacaggatatgtcagcgacaggcttaataacaaatttgttaatatttttttgttaaataaatgaacaggccaccatttaatattacccgttgcaaaataagaaaaaaaaacaaacttatagttacaaatcatcttgattaatcacatgtcgttttaactcaatgaaccattctaaatctttgggttgtgaacaattcatgttatgttgatagtgtatcctaaagtgagcttcatacatacaccggtcatgccaccgggaaactgtacaattaacaatataatcattttgcgtaataatagggtggtcactaaacactttatttttacacattccatctttacaggtccagcagaagtcacagtgttttgcataggtgcaccagaacttgagatccctttcaggaggcctacgcatttgcatcggattatctgtggaaagaggtaggttcattattatgttcgtcatcaaaattcctaaaagaacatagaagccaagaaagataagcagtcttgtagcggcttgcattcgcattcgtgagtattgtttgcgaacatagcttatgagagcaatggtagctatcatacaaagacaagtatgtttgatattctcagtgtcaatgaccctatcctcctttatttgcattaactcatcaaaccaatcataatatgtgggatttgtacagctcatgatgtgaaagcggcgtatcctagagtctgtaaagtagctacatctttcattatagcgagaaaccctacatatttgtatgtaatcattttttttgatgagagggtgtttttcaaaaaccttatttttacaaaccccgtgtcgacaattccagcagaagtcacacgattttgcataggtgcaccaatactcaagctctctctttggaggtctccgggtcattggtaactctcctgttcctggaaaagattggctttgaatgaccggctgcatgaccgccagtaccaaaaggaacacaatcaccttcatggctgcaacttataagttgcaacttatgggttgcaatactgcaacgtataggttgcaccttatagatcgcgactcaaaaggtatgaaaaccttaccctcaatacagaatttaagttttaatcctgataatgtatctgtttatgaaaaaaaattttttttactcatgtatgaattcttatacgaatcataatatgtaggctgagaataataattcatatacggtgttgcgggctcaataaaaattttgttaccacaaaaaataaatgctggatttttaagatatatatctattaatgactaaaccctttatacgctgtaggctgaaaacaatccatataatgaatatacggtgatttgggtttaataaaatacatacaacggtcaaaatagcgggcaatactacattgactaatataatcattttgtttaataagaggcatatcatcccacactttatttttacaaataccgttcctacattcccagcagaaatcacagtgttttccatacgtgcaccagtattcaagctctcttataggaggcgtataagtccttggtaaattttgtttcatataaaagatggaaaggggtcgatttaaacccggctgagatagccaaatcaaaatacataaaagagcaagtagtttcatagtggtatttagatgtaaatttttatagtatgcaaatacaatgtaacctacaaatacaatactaaatacaaggtaaaaacaacaatgtcttataatgattggccaataatcaccccccccccccccatttttccatgaatatttcatttcctgtatagggtctaggatgtgaacactccatgttatgatgattaggcattttaactgatatttcataaaaacacccccaggaattgcgattaactatacagtttacaatcgaattcatcgaattagactcatttgttatcttatttttacaaatgccattttgacaatcccagcagaagtcacaattctttacatacgtacaccaatatggaagctcctccttaggaggatgctgggttcttggtaattctggtaattcatgtgcaagaatgaggactgagtagcccaacaaaagtcctagaaccttcatgttgtgtccaaatggcacctgtcattttaaaaaagatttaaattttgctaccgcaaaaaaaatccagtatgtatttttttaatacatataattattgaagtcttataagataaagccgagaacactatattttgtatagatgatgtatccggtattcaaactctcttataagtacatgtaggaaatggtcaattattcaagattggctgagataacaacaaaaccaaaatactcaaaagcataagtaatttcatggttgtactcagtcgtagatttttgcagatcgcaaatgcaacgcaaccagcaaatacaaagctaaatacaaggtaaaaacaataataccttataatgattggccaattcttatccctccatttttccatgaacatttcatgttcataaagtctaggatacgaacaacatttcatgctatgatgattaggtattttaagtgatatttcataaaaacaccacggggttgttggtgattgataggtaagaataaggatggttgaataacctagtaaaagtcctagaaaaaccttcatattgcgttcataccacagatgttatttaaaaaaaatataaattttacagtatgtgatatacacataccacaaaaatgttcttatattaactaaaatatgtgggcagagagcaattcatataatgaatatatggtattttaggctcaataaagtacatacaacgatcaataaaacgggtaatactacatttactgatgtaatcattttgaacaataagaggcatatcatccaaaaccttatttttacaaataccattcttacaatcccagcagaaatcacagtgttttccatacgtacaccaatattcaagttctctcataggaggcgtataggtccttggtaaaatttgtttcgtataaaagatggaaaggggtcgatttaaaactggctgtgctaaccaaaccaaaatactcaaaagaacgaaaagtttcatggttgtactcagacgcagattcttacaaagcgcacatacaaagcagcctgtatatgcaataccaatgatgaaatagagacagtattgctttatagataattgttgatggtcaccccccccccccccccatgtttgcatgaatatttcatttcctgtatagggtctaggatgtaaacattccatgctaaagtgattaggcattttagatgaaatttcatataaacaggattgagtcttggaatcacggaaaactctacagtttacaatagaatgattggagtcaatgaaacgagattccgttatcttatttttgcaaatgccatcttgacagtcccaacagaaatcgcattgtggtacatacgtacaccaatatgaaagctcactcttgggaggatgctgggttcttggtaagtctggtaattcatgtgcgagaatgaggactgagtagcccaacaaaagtcccagaagaaccttcatgttgcgtctaaatgacacctgcacttacaaaaaaaaatttaaattttgaatataacacaaaaaaaccaccttaaaatttcttatattatttcttggatctgccccgacgtcatacaatgtattaaaattatagaccaatcatctttttgtatataggctaatcatctttatatatagattttagatgtttgcttgttgtatcaacttaactgctagcgaagaaaatggataaaaactttctgtatttttataggttgaaatcattttatgcacatcgctaggatctaatattttattttgaagaaccgaatgtgggcttaaaatttttttcttagaaaaaagtagaatcataatattgctatgtttttgtttaatgatttcttgtatcttttttgtatacgggttggcacccaaacctatacaaaaatatacattactcaaataactaccttctatacataatcttttttccccacgtattttcctatttatttccctatttatggaattaaaggatatcaatctctctaaggcacggtcaaggtctgcgcctaaggcaaaacaataatatatacctaatttattcccagggcgtgcacaggcaagaaacatcatgacgtttagccctaaacgtatattttcctgaaaatacgcatgatgaacttcatcaatattacctaagtatatggccgtttgtaaacgccaaagatctaaatgaggaaattttttactaagataatgaataggttttgtgagattaaaatctatggcgaacttataccaaaattttaatacaagtgtatttctcgtcatttcttcttctttttcatctaaatataagataaaacgattgtaaacaaagtctatcaataggtgaaaatcattgctattaaagctgtcgagaatcaaaatattgtcataataaatttcgatcgccagtaaaaccttttttcgtttgacgagataaacaaacatattatacaaccctacatctaaaaattctggattggctcctagttggatacacaggtctttagtctgcttcgttttggcacacatgatgccaaaattaatatcagcaccccataaaacaaataacttgattagatcagtctggttttccttcacagcttttactaaggctctgtcaagctcatagctgtcgacatcagagcatgacatagagccaccggttaccattttacattgcttacaaaaacctatgggtccgttttcccaccatagtccaagctgttgtagaataaaaatatcatcctcatgataatttgaaaaagccttggtttctatcaagactttttttgtaagaacctgtaaagagttcatcgtattattatgaataacaggagtaaacgtaatcaattataaaagtgattttttcgaaaaaaactttagatggttgaaaatgataatgtacatgttcatacaaaaaatagatgcagtgatgtctaaaatcaaaatttaattttctatgtaaaaagtacagacttacttatttgggttaaattgtttattttaaactttaattaaccgtttgagttagcgatgtttgatttatcttccatactcatccggggggggggggtccttatagctctgacattattgtggattattgaatataatgaatacttcatagatgctaaacattttaatagtagttctgaggcttaattgtactctataaatttataaaaactttttgatcaaaatttaatttcttataaaaagagtacagacgtcgcttgtttaagcttcatcatgtttcattcattactttctacaattacggggggggggagtcccctcatagctttagtattgctatggtttactaattattatgtagaatttatagaagcatatgtacctgaaagtatacctactctataaaattaaataatttcagtatattttttttatgaatagaacggaaatgatataaaaataatttaatattgcaaaaaaaattcataatgttggtatgtattataaacataatagcatgtgtaatttataaactgactcctctatataattattagatgaggtaccaacctacttatgatatgccgatgatagatattgtatactataaaacaaaattattttaaatgtattcatggatacattataacatttttaccgcaaattgtctctcagcgaagaaaatgaatgaaacgtttctgtatattcataggttgaaattattttacgcacttcactaggttctaatattttcttatgaagtattgaatgggggcttaaaagtcctttcttaaaaagaagtttcatcataacattcttttcttgtctaagaagagtttcttgtattttttttgtataaggattggcacccaaacttatacaaaaatgtacattactccaaataccataatttgaaaagaaagttatttccctatttacttcatgattaatgaaacctatcaacgtctctaaggccgtattgatatttgcgcctaaggcaaaacaatagtatatacccaatttattttgagggtacatacaagcaagcgacatcatgtcatttggatctaaacgtatattttcctgaaaatatgcatgatggatttcatcaacattacctaagtatacagccgtttttaaacgccaataatctaggtgaggaaatttcttactaagaaaacgaataggttttataagattaaactctatggcgatcttaaaccaaaattttaatacatatgtattttttatcattttttctttttcatctaaatttaagataaaacgattgtaaataaagtctatcaacacgtaaaaatcatggctatcaaaactgtcgagaatcgaaatattgtcataataaatatctatagctaataagaccttttgttgtttaattagatcaacaaacatattatacaaccctacatctaaaaattttggatcagctcctagttgaatacacagaactttcgtcctttccgtcttggcacatatgatgccataattaatgttggcaccccataaaacaaataacttgattagatcagtctggtttttcttcacagccctcaccaaggctctgtcaagctcatagctgtcaacatcagaacatgacatagagccactggttaccattttacattgtttacaaaaacctatgggtccgttttcccaccataatccaagctgctgtaaaataaaaatatcatcctcatgataatttgaaaaagccttgttttctatcaagactttttttgtaagaacctgtaaagaattcatcgtattatcatgaatgaaagcagtaaatgtaatcaattataaaattgacttattgaagagaaatgttaaatgagtgaaatcggtgtttatgatgatgtacatgatcatacgaagaaacacgttcactggtgtccatgatcaaaatttaatgttttacgtaaaaagtacagatgttaactgtttagtttaaacataaatttaacctttagtttaaaccctagttaatgatgtttaatatttcttctatactcattcagggaagtgtaatgattctaatactgttgttatggattattaatgaaaactttacagatgctggagggaataattttaatcatactgttttaatgtagctatataagctttcatcaaaatttaattttttttataaaaatacacgaattaaactaaagtctaaactttagtttgactatttgagttaatgatgcttaacttatcttccatgcttatcaagggggggtcctaatagttttgatactattgttgtggattgttgaatataataaatactttatagatgctgaaatgtttgaaaataatagtacatcaatgttgtaagtttgatcaaaatttaatttctcataaaaaaggtacacatcaacattgctcatttaagtttcatgatgtttgattcattacttcctacaattactgggggggggggggggtctttaatagctttagcattgttatggtttgctgactattatgtagaattcatagaagcacgtttagatagtaatatcactgcagtgtagattatgaaatacatactaaactaatttcagtatattttttttgttcatataagttaaggtacaaaaatgattaaacattgcaaaaaaagaaaatcacaatgctattatacatagtgatcatagtggcttgtatcatttctaaactagttccaaatgaatattgggcaatacatctattttttatcattatgatttttatggtatatatgtatgaaaagttagatatacatcaaaaatctcagttctggaattataccatgtcaggcttatctggacataacgtacaggtaacatgtaagtgttactaaatactatgaagtatctattttttttgttgtaaaaaaaagaacttgatagtattttttaaaaaataaaataattaattgtacgtcaacttccttattttattctttaaaaataactcgtaagtattatttatctattttttgaaaaaatagatgtaatcggtttcatcatttaggtgtgtatttctttttagcatctatcaagaattcattgtttagtgatatgaaaacaatgaatgatcattatcttctatttaacaaccacctaaataaatgaacgtctttttcatcttaactgattaccaaaagttattttgcgaaaaggcatacatatgatcaatatcagacctacaatgaatatttccataatatccctttattgtaataattctatttttgcattccgatatctcatcatctgtgctattatatgtttccataactgtttcatcatcaaacataaatcctgttaaataggcaaaagactttaatcccggatagatttttaccattttcctgagagccgtgtatagcttgtaataaatggccaaaaatatgcaataaagcgtagaaagagagtaatttttggcataaaagattttgaaggtttgatgaatggctaaatcgcatataatataagatacgattttaaagcgcacctgttcacgcagatttgttgaaaaattcgtggaaagatttaacaaataaaaggttattaatagttgctcatcattccccttatacgacatcgtcagacgctctaatattttactactaggcacatctgccacatgttgaacatttaaagcctgttcttcttctgtgttacggcaaaagagccgtgcgtattcaggtgaagctccccaggataacaacgtccttgctacggctaaattttttttgacgatgacttttatcagaaataagtctttatttttgcattgatcactatgcgaatttgtatagttgacgccgttgcattgagtacattgatataatgttttacaattccagcgtagccctaaatggtataaaagaactgtattttcgacataagcatgctgattaacgatgtttttgagacaacacgtcgttaaggacaccatattgtctccaatttgttagataaaagtctttactaaaaaaatagatttttagttttaacaatcgagattttattatttggatgcatcatcaaaaagatttataagtataagaggttgtataagaaaaaaatgatgttatactatttatgttaaaatttaatttatcatataaaaagtacagatttaatcagttggttaaactatttagttaattaaactaaatagtttaaccatttagtcagactacttggttagcaatgtttgagctttcttccattcttatccgggggggggggtcctaatcgttctaatactattgtggatagttgaatataatgaagactttatagatgctataatgatgaattctagtatgcctgtataaaataattaacctttttgatcaaaatttaatttttttataaaaagctacagagtagtgttttattaaacgtggcttatttaaaagttacacaatgttaaaatctctacttactttaattctttgtggggttttattaactttatccatattatggcttactacttaccatgtagaacttatagaggcaatagatgatttctacgactgaaatatagaatagtccattttctatttgtaaaataatgatttatattctttcctaaaaatgatactttatatggtttgaaaacaaatattaacaacttgatttttttttctataaataaactataaatgaaaatagtaaaactcatagagtcttataagtgaacatcttcataatgttactcaaacgttggactattaaaaaatattccgtgtgcattattgcttttaatcagtatgattactttatacgaagccgctattaaaacgcttatcacacaccgaaaacaaattttaaaacaccccgatagccgtgaaattttactagctttggggttgtactgggataaaactcatattcttgttaaatgtcgtgaatgtgggaatatgagtcttaccggaaaacacagtacaaaatgtattaacattaattgtctacttattcttgccataaaaaaaagaataagcgtattgttgataccttgataggaatgggcgcggatgtaacatatatacatcttttaaagaataagataaaactgtcatacaaccagctgtctatgcttaaaagcaactcgcagatttcattgaaggagcttcatgctatatgctatcttttatatggtcggcttcccaaaaaaattaaacaagggatgcgactgtgtaaaacaatggcgggactatgtggtgaacttttatgtgcatttttagctccgtaaatgataatatgtatttaaaacaaacagatattaccaaaatatattctatgtacataatatctgggaaattatttttttttctcatacccttaaatataaaaatattgggtttcttcactaaactttagaggtaaaaatttttctttgttttgcaccatcatgtatgggtttaggctgtcccagggattgtttatttgaatatttcctaaataggaacacaacgccatgatcatatatctttcattctggtaagctttttgatacatcttcaaagatgccgtacctccgagtgtgtaacagcaaacaaacgtccgtacttttccatgggtcgcagcccattccattccgtagctcagcatcttttgctgtatttttttattcgctttataaaaaaagtttttcatccattccacgttctcataaaaacaggcacttaaaaagagcactaggggtagtgtagtcttattatagaatgtaggaatgtatgttttagttatttttttcaacgcgtgttccatactatgttttaccgccataaaaatacaaaaccaataccaactttttctataaaaggttttgctgtacacatataaacgagcaaaatatatttcaaactctatattctttttataaaaaaactcgagacagtcgtttatgttacgactttttctaaatacctcaaaaacagtaattaattcactgtcgctgtggaaatgttcgtaagctaactgtttaatgtctttaggggtcaattctttttttgggagcagtggtttgagattcggcaaaggtcgtctaaagtagtgagcgaacttttcattcgctccccaacacaaaagccgataagccagcatgtagttatcacgttttaccgcgtaaataagcaaatagtttatattgatacatgtaccatgttgctgcccgtttggacatatgttgccgcattctgaacacttatgaatgagatcatagttcttacaacataaccccaaacgggttagtacttctttgtcacgttttaaaaactcgacatgattctttaatgttaatgctttgagcgcaatgttaaataaactctgcattttattaaaatgaggttagtatcatgttttagtataaaatttagcggctgtttacataatgctaaataaacttaacgttcctactaaaccaaaaaaaatcaaattgactaagtcatagagaatttgacgatgttggtaggtaattttttaacatggtatatatttttttagggtcggttatattaggtaataaaagaggacgtgccgttaaagtattttgcttaagatcctttagatccttacaaaaatatagattgttcgtctgatgatgccactgtgttgcagtgatggcttgatcaatatcacctcccaagacaaaacagtagtatatcgttaaaaagttgtaatctttcatacaagccaactgcatcattttatcgatgtccatatgaacgatcttttgctcgtatatttcatgaaggtcaaatacattgttgaagtaaatggcgcacatgagtcgccacatactaaggtgcccatatgtttgatagaaaaaggagatagctcttttaagcttatattttactgctatggcatagcagtatttaacgaatacgttcatgggtacattatctaagatataaaatatgaaaaactttaactctcgatgaatctcttcccccatttcctgtacatttagagcttccaacataggatttttatcaaatatttcatgacataaaataatgttattgctcgttttatgacgcattaaaccggtgaaaatttccttattatttaaactatctttagctcctaactttcgacacagctcctgagtttgttccgtcctagcacaggtcagcccataataaatgtttgctccccactcggtgaacagccttattacgtcatagttattttcttttatggccatgattaatgccacatcaagatgaagaagttcccccttaaagggggttgagcttaaaataacgtaattacagtagtgacataagctaatgggcttgttttgccaccataagccacaatattttaaaatataatgatactcctcaggcacgctctgtttggccacagcctttttggccagggtttgcaaggagagcatgataacttcttgaaaaaaaaactcaaattaagttcctacttttttaaaatattagtatggacagatctaccatcatatgaaggaattctttcatcgttaaacactgaagagataatactttcatcgtatagagaatatcatgtcaatccatatattgaatgttatatatcattaaacccatcattaatatagtgtttatgtgctatggacaggttttttgaatgataatcttttaacatacgttttataacttcgggatcagtttcttttaaagataaagaatcattcatgttataacaatttaatgataacatgctggcaatgaacgagttgtctttttgatgcgctagagtctttccctcctcaaaggcattggcgcctaagtctatacaaaagaatatgtttccgatattatagaactgaatagaatgaaacatggcctgattgatatcagcccctaagacgacgcaacagtaataaatcgttaaatagttatagttcttgcgacaggcccactttagcatttcattcatgtctatgcgaatcctctccttttcgtacacttcgtgaagttcaaacacattattgtaaaaaagggcgcacataagccgccaccgatgtagatgagcatatctctgataaaaatagcaaatcgcctccttaaggttacattctattgccatcgcgtaccaatatttagtaaacatctcgcttaatatatcggtttctaccattaatccctccagttgttcataaatcattccctttacttcaaaacgatttatggtatctaaaatgggattattagaaaatacctcatggcagaaaatgatgttactgctagttagatcacgtttcaatgtgtaaaaaaatcgtaaaatttcctggtcatttaactgttctttggcacctagctgcctgcacaggtctcgggtgtgctccgtgttgacagaaagcaaaccgtagttgatgtttgcaccccactcggtgaacaattctattagatcgtgattgttttcctccacagctttcaccaaggccgcgttaagatttgtgccgttcttaaaatacggcgtccatattttcttttgatgatacatgatagggccattatgccaccatagaccgcagcacttcaaaaaatgaggatggcatttggccggatactggctggccagcacctttttggtgagagtctgcagagagaggaccatatttcttttttttgaaaaaatcaaattaaaaaaatcatgcttgtttagcatacatgtaatattgttataattacgttataattacgttataattacgttataactatattataacaatggtataacaatggtataacaatgttataacaatgttataacgatgtatcattgatgtcatcattcaactaggccaacatactttttaatttatagttttttaatagatgatatattttgttaggatctgcttcttttaacgttaatagcgaggagtctgcactataaatgtctaatgataaatgatgagatatcaaatagtaattccgttgctctgctagggcctttgcctcttcaaaggcgtcggctcccagatctatacaaaagaacaagttatccatattataaaatcgtacgcaggcaagcatagctgaattaatattagctcctaagagaaaacaataatatatggttaaaaaattgttatcttttgtgcaggccatccgcatcatttcatccacgtccatgcggatcttttccttttcatacaaattatgtaggtcaaacagcttattaaaacaaagagcacagattaaccaccacgtatttagatacttaaaatgttggtaaacataagaaatggcctccctaagattatcctgcaatgccactataaaacagtatatcgttaacatatcaccatccgacatattacttaatatgtcggtgtcttctactaaccttttcaacttccaatatatggatgaccttatttcccttataatgacataggctggaaagggattatcattaaaaagtttaagacataagataatattactgctagtagtgccagggtgtattaatttaaagaacatgtgcataatcttctttttatccacgcggtacttggctcctaattcccagcaaaattctcgaacaggcggcgtattggcgcaaattaacccatagttgatgtctgcgccccattctgtaaacagttttattaactgatagttgttttcctttgtagccaacattagtgccgtattaaggtccaagccgtctgcaaagcttggcagctttatcagcatatgtttgcaatcaagggaaattggggccttataccaccatagtccgcagcgttctaagataacatggtactcaatagatacttgctgtctggctagtacctttttggcgaaggattgtaaggaaggaaacatcctgtttctttttttttaaaaatcaattatctttgttcataatcaagaaaaatccccatatttattgagtgataattttttaacatgcaatttattttttcagggtccgtaacgatcgacaacagagaaataaccggattgtaatgctttaatgataaggcatgggctatcagataattttccttttgttctgccaaagctttgccctcctcaaaggcatcggcacccaggtctatacaaaagaacaggtttccaagattatagttttgtatggaaacaagcatggcttgattgatgttggctcccatgataaaacagtagtaaatggccgaatagctataatcttggatgcaggctatgtgcatcatttcatcaatatccatgcggaccctttctatttcgtacagctcgtgaaggtcgaacacgttgttgtaaaaaagggcgcacatgagccgccacctatgtagacgcgggtatttctggtaaaagtagcggatagcatctttgaggtcatagtccaccgctatcgcgtaccagtatttggttaaaacagtgctaaagctatcatcatggtccagcatgaaggttatctccatgagccctcttaactcccacatgatttcccccctcagatccagattatctataatccttaaattggggttattggaaaacacctcgtggcaaaagataatattgctactggttttatcgcgcgttgtatcaaagaaaatttttaaaatatactctctttctaaatattctttggctcccagctctttgcacagatcacgggtattttccgtgagagcacaaatcattccatagttaatatctgcaccccattcagtaaacagctttatcaagtcatgattattctccttcacggctttcatcagtcctatgtttaactcgataccttgactaaaacaggttgaccttataaataatttattgcgtcgaatatgaagcataatggggccattatgccaccacaggccacaacacttcaggacatgatattgatctaccggtatacactgcccggccagtactttcttcgtgagggattgcagggaaggcaacatgcctttccatcctttgacggaaatcaaattatctactaataactatcagtgtttatattaagtatttagatattatcccgggctggatacgtagtatcgctattcacatgtacttccaactctagccggagcctgcagggtcatttatttttaatattgattcttttttgtatttaatcatttagagaaggtcatcataggagccagatgttctctctccagaacttatgtcgaaaaacattacctaaccgtaaacttcctgaattttttgacgaatatatattacaactgctgggattatactgggaaaaccatggaactattcaacgagcaggaaacaactgtgtgcttatacagcaacataccctcattcccgtaaatgaagccctgagaacagcagcatctgaagaaaattatgagatcgtgagccttttattagcgtgggaggggaacctttactatgctattataggggctctagagggcaaccgccacgacttaattcgtaaatatgatgaccaaatcaaggaccatcatgaaattctgccattcattgacgatccagtcatatttcacaaatgccatatcatgcggcaatgcttttttgattgtattttatatcaagctgtaaaatatagtaagtttcgcgttcttctttactttaaacatagattagaggatgatttgcccttcactcatttacttattgaaaaggcatgtaaagatcataattatgaagttattaaatggatatatgaaaacctacatatctacaatatgatagatacctttgaatgtgctattgcccataaggatctacatctatattgtttggggtatagatttatatataacagaatcgtacccgataagtatcatcatttagatattcgcatgctttcaagcctacaactcctacataaggtggcagccaaaggatacttagattttatcctagaaaccttaaagtatgatcataataaagataatataaatattattctaacacaagctgcaacctataaccatagaaaaattttaatctatttcattcctcaatcaacccacgcacagatagaacaatgtttactagtggcgataaaagcaaaatcttccaggaaaaccttgaacttactactgtctcacctaaacctttccatcaacctcatcaaaaaaataagccattatgttgccacttacaattcaacaaatataataggcattctgagtatgcggcggaaaaagaagatatatttagatatcatattgacaaaatttgtaaaaaaagctatttttaataagtttgtcgttcgatgtatggatacattttctataaacccggaaagaatccttaaaatagccgcgcgaataaataggatgatgttagtgaaaaaaatatctgaacatgtttggaaaaatcatgcggttagacttaaataccttaaacatgcggtacacacgatgaagcataaagatgggaaaaatagactcatgaactttatctatgatcgctgttattaccatatgcaaggggaagaaatctttagcctcgcaagattttatgcaatccatcatgcaccaaagttgtttgacgttttttatgattgttgtatcctagatacgatacgattcaaaagccttcttttagattgttcacatatcataggtaaaaacgctcatgatgctaccaatatcaacatcgtgaacaagtatatcggcaacctgtttgttatgggagttcttagcaaaaaagaaatcttacaggactatccatccatttattctaaacaatacatgccttagtttattttttttgcggccgaaacattattcttaccctagaaaacgcttatagtcatcttaaatcataggtaaggaagatcatcatattttttgaaacgtaattttttaacgcatgatctatgatttcagggtccgtgcttttaggcaacggggtggtggccggactataaatctttagggataaaatgttctttataagctcatacccttcccctaaagctgtagtaccctcttcgaaaacatcagcccccagatctatacaaaagaacatgttttctatattatagtactgtattgagctaagcatggcttgattgatgttggcgcccaggacatagcagtagtacatggttgaaaggttgtggtctttgatgcaggcgatccgcatcatctcttctatgtccatatggatcttgtccttttcatacgcctcatgaaggtcaaacacattattaaaacaaagagcacatgttaaccgccacgtattcaggtgtgtatatttttggtaaaaatactgtatggcctctttcaggttatagcgtatggctatagcgtaccagtatttgagtagtaatgtactgagcgaaaactcattatttagcagatcggtttttactattaactcccttaactcccagaaaatttctatcctcatttttatattatttactttttgtaatatcggattgttggaaaacacctcatggcataaaataatgttactactagttttatgaaactttagatctataaaaatttgtaaaatttcttcttcattcaaggtttccttggcacctagctctcgacagaggtcccaggtgtgctccgtgttgacagataccagcccgtagttgatgtccgccccccactctgcaaacagttttataaggttgtagttgttttcccttacagccttcactaacgccgtatttaggtttaagccctctttaatacctgctgattttatgagccttaggttatgatcaaacgtgatcggagcatcatgccaccataggtcataacactttaaaagataatgttggttcgtgggcacgcattgtccagccaacacctttttggtcagagattgcagggaaggcaacatgtctcttcatcttttaaaaaaaaatcaaattaattagccgaataaatttttctttcgagggctttttaaaagagctctttaagagctctttaagagctttttaagagattaaaaaattattcttgctggcattctgccaagtatgcggcattcctatcatctatagtatattatgagaatattcccaaatgatggataagttttttgatttataatcttttaataaactgcttatttcttcggggtcctttaagtttagtggcaaggaagcatctgagctgtaaatatccaaagccaaactatggctcagaaaattataacctttttgttccgctatggcacgaccctcttcaaaggcattaccacccaaatctatacagaaaaatatattaccgatgttataatattgtactgaagtaagcatagcttggttgatgttgccccccagcgcgtaacagtaatatattgttaatggattgttatccttggtagaagccagacatatcatgtcatggacgtctatttggatgttttccttgtggtacatctcatgaagctcatatattttgttataatacaggagacattttaatcgccattcattaagatccgtatatttctcatctagaaaacaaatggcgtccttacaatcgtattgtactgctttggcgtaccaatacttcactagtaaaccatttaactcgtccgtttcttttatttctatgagcccccatagtcttttataaattaagccccttaattgtataacaaatttgttttctaaaataggattattcataaaaatttcatggcacaaaataatactgccgctggttttattgtgcattatcctggtaaaaatacggaaaatatcgttgtcctctagagtttctttggcgcctagctgtctacacaactctcggatgtgcttcgtattgatagaaagcaaaccatagttgatatttgcgccccactctgtaaagagctttatcagactatagttgttttccttaacagctattattaatgccacacgaaggtctatatcttctcctaaaaatcctgattttatttgtattcggccacgatccatacaaagcttgagaggagcatcatgccaccataggccacaatatttcaaaatgcagtgttcatctattgacaaacactggctggctatcgtctttttgacgagggtctgcagagagagcggcaacgacatgtttctttttcaccaaaaaaaatcaaatgttctcgtctttaaaggttaattcatgttcttaaaatgttcatttcatgatagtgattaataatatggtttaataacgctagaaggcttgtttataagacagtcataagcagtctataagacagtctataagcagtctataagacagtctatgacttagtctataactataatttctggatgggctgtaagatactcttcggctcgtttcagattttttgaagtatatgtctttagcatatcatatatttcctggggttcggttacatctaataccaaggtcacatcacggctgaaaagctgctttactaagaaaatgttgctcaagttatacatataagctttgtgcgcaatgagttgtgccctatcaaaatcggcagcccccaaatcaatacagaaaaacatgtttaaagtattattgttatagatagaaagattcatgccataatcgagactagcccccaacctatgacagtaataaatggccgcgtaatttttttcccgcaagcaagcaaatttcatcatcagattagggctgatgcaaatctctttttcacgacacaactcgtgtatgtcaaaaatgttattaaaataaaggctacaagctacccgccaatagaggtgatttttatgccttttatagaaatagtgaatagcctttgtaaaattatgtcgtaatgccagggcaaaccaaaactttgttaataggtggtgcgccgtatcccccgtcaacggaatgtttgaacaggtgtacgtaactgtgtctaaagtggttctagttacggtttccaagagtggattatgacaaaacatgtcataacccagcagaactcctgcacaggattttagcctggccacttcttttaaaatttccagaagacggggttcggatacaggcgttaagcctcccagttccgcacacagccgctttagatacacggcaggaacacgtataagcccatattcaggatttgcgccccaatccacaaataaacgtataagttcaagattatcgctcttcacggcctttactagcgccgcttcgagacaaagatcatcctcagaaaaacactgtaaatgttta

SEQ ID NO: 424 - protein, 254 aa, Artificial Sequence
  SYNTHETIC CONSTRUCT DERIVED FROM HUMAN THOUGHT
  MISC_FEATURE (29)..(29): X29 is D or N
  MISC_FEATURE (29)..(195): AT LEAST ONE OF X29, X42, X50, X131, X152, X160, and X195 is D
  MISC_FEATURE (42)..(42): X42 is D or N
  MISC_FEATURE (50)..(50): X50 is D or N
  MISC_FEATURE (131)..(131): X131 is D or N
  MISC_FEATURE (152)..(152): X152 is D or N
  MISC_FEATURE (160)..(160): X160 is D or N
  MISC_FEATURE (195)..(195): X195 is D or N
MVNSCTFLHIFLCCSFLYSFCCAVVAGSXTTYCFWFPLVRGXFSFELTVXYTVCPPCLTRQAATEIYEPGRSLWCRIGYDRCGEDDHDELGFMIPPGLSSEGHLTSVYAWLAFLSFSYTAQFHPEIFGIGXVSRVYVDIKHQLICAEHDGQXTTLPRHDXISAVFQTYYQHQVDGGNWFHLEWLRPFFSSWLVLXVSWFLRRSPANHVSVRVLQILRPTPPQRQALLSSKTSVALGIATRPLRRFAKSLSAVRR

SEQ ID NO: 425 - protein, 203 aa, Artificial Sequence
  SYNTHETIC CONSTRUCT DERIVED FROM HUMAN THOUGHT
ATVYDIGHDAVMYVAERKVSWAPRGGDEVKFEAVPGELKLIANRLRTSFPPHHTVDMSKFAFTAPGCGVSMRVERQHGCLPADTVPEGNCWWSLFDLLPLEVQNKEIRHANQFGYQTKHGVSGKYLQRRLQVNGLRAVTDLNGPIVVQYFSVKESWIRHLKLAGEPSYSGFEDLLRIRVEPDTSPLADKEEKIFRFGSHKWYG

SEQ ID NO: 426 - protein, 470 aa, Artificial Sequence
  SYNTHETIC CONSTRUCT DERIVED FROM HUMAN THOUGHT
  MISC_FEATURE (14)..(14): X14 is N or D
  MISC_FEATURE (14)..(468): AT LEAST ONE OF X14, X96, AND X468 IS D
  MISC_FEATURE (96)..(96): X96 is N or D
  MISC_FEATURE (468)..(468): X468 is N or D
SLCQVIEDCCCSQXKTNRVTPEEVAAKIDLYLRGATNLEECLARLEKARPPRVIDTSFDWDVVLPGVEAATQTIKLPQVNQCRALVPVVTQKSLDXNSVPLTAFSLANYYYRAQGDEVRHRERLTAVLSKLEKVVREEYGLMPTEPGPRPTLPRGLDELKDQMEEDLLKLANAQTTSDMMAWAVEQVDLKTWVKNYPRWTPPPPPPKVQPRKTKPVKSLPERKPVPAPRRKVGSDCGSPVSLGGDVPNSWEDLAVSSPFDLPTPPEPATPSSELVIVSSPQCIFRPATPLSEPAPIPAPRGTVSRPVTPLSEPIPVPAPRRKFQQVKRLSSAAAIPPYQDEPLDLSASSQTEYEASPPAPPQSGGVLGVEGHEAEETLSEISDMSGNIKPASVSSSSSLSSVRITRPKYSAQAIIDSGGPCSGHLQEVKETCLSVMREACDATKLDDPATQEWLSRMWDRVDMLTWRXTS

SEQ ID NO: 427 - protein, 111 aa, Artificial Sequence
  SYNTHETIC CONSTRUCT DERIVED FROM HUMAN THOUGHT
NGPNAWGDEDRLNKKKRRRMEALGIYVMGGKKYQKFWDKNSGDVFYEEVHDNTDEWECLRVGDPADFDPEKGTLCGHVTIENKAYHVYTSPSGKKFLVPVNPENGRVQWEA

SEQ ID NO: 428 - protein, 553 aa, Artificial Sequence
  SYNTHETIC CONSTRUCT DERIVED FROM HUMAN THOUGHT
  MISC_FEATURE (1)..(1): X1 is D or N
  MISC_FEATURE (1)..(551): AT LEAST ONE OF X1, X158, AND X551 IS D
  MISC_FEATURE (158)..(158): X158 is D or N
  MISC_FEATURE (551)..(551): X551 is D or N
XRTFTLGPVNLKVASEVELKDAVEHNQHPVARPIDGGVVLLRSAVPSLIDVLISGADASPKLLAHHGPGNTGIDGTLWDFESEATKEEVALSAQIIQACDIRRGDAPEIGLPYKLYPVRGNPERVKGVLQNTRFGDIPYKTPSDTGSPVHAAACLTPXATPVTDGRSVLATTMPPGFELYVPTIPASVLDYLDSRPDCPKQLTEHGCEDAALKDLSKYDLSTQGFVLPGVLRLVRKYLFAHVGKCPPVHRPSTYPAKNSMAGINGNRFPTKDIQSVPEIDVLCAQAVRENWQTVTPCTLKKQYCGKKKTRTILGTNNFIALAHRAVLSGVTQGFMKKAFNSPIALGKNKFKELQTPVLGRCLEADLASCDRSTPAIVRWFAANLLYELACAEEHLPSYVLNCCHDLLVTQSGAVTKRGGLSSGDPITSVSNTIYSLVIYAQHMVLSYFKSGHPHGLLFLQDQLKFEDMLKVQPLIVYSDDLVLYAESPTMPNYHWWVEHLNLMLGFQTDPKKTAITDSPSFLGCRIINGRQLVPNRDRILAALAYHMKASXVS

SEQ ID NO: 429 - protein, 441 aa, Artificial Sequence
  SYNTHETIC CONSTRUCT BASED ON HUMAN THOUGHT
GKKSRVCGYCGAPAPYATACGLDVCIYHTHFHQHCPVTIWCGHPAGSGSCSECKSPVGKGTSPLDEVLEQVPYKPPRTVIMHVEQGLTPLDPGRYQTRRGLVSVRRGIRGNEVGLPDGDYASTALLPTCKEINMVAVASNVLRSRFIIGPPGAGKTYWLLQQVQDGDVIYTPTHQTMLDMIRALGTCRFNVPAGTTLQFPVPSRTGPWVRILAGGWCPGKNSFLDEAAYCNHLDVLRLLSKTTLTCLGDFKQLHPVGFDSHCYVFDIMPQTQLKTIWRFGQNICDAIQPDYRDKLMSMVDTTRVTYVEKPVRYGQVLTPYHRDREDDAITIDSSQGATFDVVTLHLPTKDSLNRQRALVAITRARHAIFVYDPHRQLQGLFDLPAKGTPVNLAVHCDGQLIVLDRNNKECTVAQALGNGDKFRATDKRVVDSLRAICADLE

SEQ ID NO: 430 - protein, 153 aa, Artificial Sequence
  SYNTHETIC CONSTRUCT DERIVED FROM HUMAN THOUGHT
GRYFTWYQLASYASYIRVPVDSTVYLDPCMGPALCNRRVVGSTHWGADLAVTPYDYGAKIILSSAYHGEMPPGYKILACAEFSLDDPVKYKHTWGFESDTAYLYEFTGNGEDWEDYNDAFRARQEGKIYKATATSLKFYFPPGPVIEPTLGLN

SEQ ID NO: 431 - protein, 2040 aa, Artificial Sequence
  SYNTHETIC CONSTRUCT DERIVED FROM HUMAN THOUGHT
  MISC_FEATURE (1)..(1): X1 IS D OR N
  MISC_FEATURE (1)..(2038): AT LEAST ONE OF X1, X264, X346, X718, X1761, AND X2038 IS D
  MISC_FEATURE (264)..(264): X264 IS D OR N
  MISC_FEATURE (346)..(346): X346 IS D OR N
  MISC_FEATURE (718)..(718): X718 IS D OR N
  MISC_FEATURE (1761)..(1761): X1761 IS D OR N
  MISC_FEATURE (2038)..(2038): X2038 IS D OR N
XTSPLADKEEKIFRFGSHKWYGAGKRARKARSCATATVAGRALSVRETRQAKEHEVAGANKAEHLKHYSPPAEGNCGWHCISAIANRMVNSKFETTLPERVRPPDDWATDEDLVNAIQILRLPAALDRNGACTSAKYVLKLEGEHWTVTVTPGMSPSLLPLECVQGCCGHKGGLGSPDAVEVSGFDPACLDRLAEVMHLPSSAIPAALAEMSGDSDRSASPVTTVWTVSQFFARHSGGNHPDQVRLGKIISLCQVIEDCCCSQXKTNRVTPEEVAAKIDLYLRGATNLEECLARLEKARPPRVIDTSFDWDVVLPGVEAATQTIKLPQVNQCRALVPVVTQKSLDXNSVPLTAFSLANYYYRAQGDEVRHRERLTAVLSKLEKVVREEYGLMPTEPGPRPTLPRGLDELKDQMEEDLLKLANAQTTSDMMAWAVEQVDLKTWVKNYPRWTPPPPPPKVQPRKTKPVKSLPERKPVPAPRRKVGSDCGSPVSLGGDVPNSWEDLAVSSPFDLPTPPEPATPSSELVIVSSPQCIFRPATPLSEPAPIPAPRGTVSRPVTPLSEPIPVPAPRRKFQQVKRLSSAAAIPPYQDEPLDLSASSQTEYEASPPAPPQSGGVLGVEGHEAEETLSEISDMSGNIKPASVSSSSSLSSVRITRPKYSAQAIIDSGGPCSGHLQEVKETCLSVMREACDATKLDDPATQEWLSRMWDRVDMLTWRXTSVYQAICTLDGRLKFLPKMILETPPPYPCEFVMMPHTPAPSVGAESDLTIGSVATEDVPRILEKIENVGEMANQGPLAFSEDKPVDDQLVNDPRISSRRPDESTSAPSAGTGGAGSFTDLPPSDGADADGGGPFRTVKRKAERLFDQLSRQVFDLVSHLPVFFSRLFYPGGGYSPGDWGFAAFTLLCLFLCYSYPAFGIAPLLGVFSGSSRRVRMGVFGCWLAFAVGLFKPVSDPVGAACEFDSPECRNILHSFELLKPWDPVRSLVVGPVGLGLAILGRLLGGARCIWHFLLRLGIVADCILAGAYVLSQGRCKKCWGSCIRTAPNEVAFNVFPFTRATRSSLIDLCDRFCAPKGMDPIFLATGWRGCWAGRSPIEQPSEKPIAFAQLDEKKITARTVVAQPYDPNQAVKCLRVLQAGGAMVAKAVPKVVKVSAVPFRAPFFPTGVKVDPDCRVVVDPDTFTAALRSGYSTTNLVLGVGDFAQLNGLKIRQISKPSGGGPHLMAALHVACSMALHMLAGIYVTAVGSCGTGTNDPWCANPFAVPGYGPGSLCTSRLCISQHGLTLPLTALVAGFGIQEIALVVLIFVSIGGMAHRLSCKADMLCVLLAIASYVWVPLTWLLCVFPCWLRCFSLHPLTILWLVFFLISVNMPSGILAMVLLVSLWLLGRYTNVAGLVTPYDIHHYTSGPRGVAALAIAPDGTYLAAVRRAALTGRTMLFTPSQLGSLLEGAFRTRKPSLNTVNVIGSSMGSGGVFTIDGKVKCVTAAHVLTGNSARVSGVGFNQMLDFDVKGDFAIADCPNWQGAAPKTQFCTDGWTGRAYWLTSSGVEPGVIGKGFAFCFTACGDSGSPVITEAGELVGVHTGSNKQGGGIVTRPSGQFCNVAPIKLSELSEFFAGPKVPLGDVKVGSHIIKDISEVPSDLCALLAAKPELEGGLSTVQLLCVFFLLWRMMGHAWTPLVAVSFFILNEVLPAVLVRSVFSFGMFVLSWLTPWSAQVLMIRLLTAALNRNRWSLAFFSLGAVTGFVADLAATQGHPLQAVMXLSTYAFLPRMMVVTSPVPVITCGVVHLLAIILYLFKYRGPHHILVGDGVFSAAFFLRYFAEGKLREGVSQSCGMNHESLTGALAMRLNDEDLDFLMKWTNFKCFVSASNMRNAAGQFIEAAYAKALRVELAQLVQVDKVRGTLAKLEAFADTVAPQLSPGDIVVALGHTPVGSIFDLKVGSTKHTLQAIETRVLAGSKMTVARVVDPTPTPPPAPVPIPLPPKVLENGPNAWGDEDRLNKKKRRRMEALGIYVMGGKKYQKFWDKNSGDVFYEEVHXNT

SEQ ID NO: 432 - protein, 1295 aa, Artificial Sequence
  SYNTHETIC CONSTRUCT DERIVED FROM HUMAN THOUGHT
  MISC_FEATURE (1)..(1): X1 IS D OR N
  MISC_FEATURE (1)..(1293): AT LEAST ONE OF X1, X556, X908, AND X1293 IS D
  MISC_FEATURE (556)..(556): X556 IS D OR N
  MISC_FEATURE (908)..(908): X908 IS D OR N
  MISC_FEATURE (1293)..(1293): X1293 CAN BE D OR N
XRTFTLGPVNLKVASEVELKDAVEHNQHPVARPIDGGVVLLRSAVPSLIDVLISGADASPKLLAHHGPGNTGIDGTLWDFESEATKEEVALSAQIIQACDIRRGDAPEIGLPYKLYPVRGNPERVKGVLQNTRFGDIPYKTPSDTGSPVHAAACLTPTDGRSVLATTMPPGFELYVPTIPASVLDYLDSRPDCPKQLTEHGCEDAALKDLSKYDLSTQGFVLPGVLRLVRKYLFAHVGKCPPVHRPSTYPAKNSMAGINGNRFPTKDIQSVPEIDVLCAQAVRENWQTVTPCTLKKQYCGKKKTRTILGTNNFIALAHRAVLSGVTQGFMKKAFNSPIALGKNKFKELQTPVLGRCLEADLASCDRSTPAIVRWFAANLLYELACAEEHLPSYVLNCCHDLLVTQSGAVTKRGGLSSGDPITSVSNTIYSLVIYAQHMVLSYFKSGHPHGLLFLQDQLKFEDMLKVQPLIVYSDDLVLYAESPTMPNYHWWVEHLNLMLGFQTDPKKTAITDSPSFLGCRIINGRQLVPNRDRILAALAYHMKASXVSEYYASAAAILMDSCACLEYDPEWFEELVVGIAQCARKDGYSFPGTPFFMSMWEKLRSNYEGKKSRVCGYCGAPAPYATACGLDVCIYHTHFHQHCPVTIWCGHPAGSGSCSECKSPVGKGTSPLDEVLEQVPYKPPRTVIMHVEQGLTPLDPGRYQTRRGLVSVRRGIRGNEVELPDGDYASTALLPTCKEINMVAVASNVLRSRFIIGPPGAGKTYWLLQQVQDGDVIYTPTHQTMLDMIRALGTCRFNVPAGTTLQFPVPSRTGPWVRILAGGWCPGKNSFLDEAAYCNHLDVLRLLSKTTLTCLGDFKQLHPVGFDSHCYVFDIMPQTQLKTIWRFGQNICDAIQPDYRDKLMSMVXTTRVTYVEKPVRYGQVLTPYHRDREDDAITIDSSQGATFDVVTLHLPTKDSLNRQRALVAITRARHAIFVYDPHRQLQGLFDLPAKGTPVNLAVHRDGQLIVLDRNNKECTVAQALGNGDKFRATDKRVVDSLRAICADLEGSSSPLPKVAHNLGFYFSPDLTQFAKLPVELAPHWPVVTTQNNEKWPDRLVASLRPIHKYSRACIGAGYMVGPSVFLGTPGVVSYYLTKFVKGEAQVLPETVFSTGRIEVDCREYLDDREREVAASLPHAFIGDVKGTTVGGCHHVTSRYLPRVLPKESVAVVGVSSPGKAAKALCTLTDVYLPDLEAYLHPETQSKCWKMMLDFKEVRLMVWKDKTAYFQLEGRYFTWYQLASYASYIRVPVXST

SEQ ID NO: 433 - protein, 116 aa, Artificial Sequence
  SYNTHETIC CONSTRUCT DERIVED FROM HUMAN THOUGHT
  MISC_FEATURE (38)..(38): X38 IS D OR N
  MISC_FEATURE (38)..(44): AT LEAST ONE OF X38 AND X44 IS D
  MISC_FEATURE (44)..(44): X44 IS D OR N
SLDVVAHFQHLAAIEAETCKYLASRLPMLHNLRMTGSXVTIVYXSTLNQVFAIFPTPGSRPKLHDFQQWLIAVHSSIFSSVAASCTLFVVLWLRVPILRTVFGFRWLGAIFLSNSQ

SEQ ID NO: 434 - protein, 254 aa, Artificial Sequence; identical to SEQ ID NO: 424
  SYNTHETIC CONSTRUCT DERIVED FROM HUMAN THOUGHT
  MISC_FEATURE (29)..(29): X29 IS D OR N
  MISC_FEATURE (29)..(195): AT LEAST ONE OF X29, X42, X50, X131, X152, X160,  AND X195  IS D
  MISC_FEATURE (42)..(42): X42 IS D OR N
  MISC_FEATURE (50)..(50): X50 IS D OR N
  MISC_FEATURE (131)..(131): X131 IS D OR N
  MISC_FEATURE (152)..(152): X152 IS D OR N
  MISC_FEATURE (160)..(160): X160 IS D OR N
  MISC_FEATURE (195)..(195): X195 IS D OR N

SEQ ID NO: 435 - protein, 178 aa, Artificial Sequence
  SYNTHETIC CONSTRUCT DERIVED FROM HUMAN THOUGHT
  MISC_FEATURE (37)..(37): X37 IS D OR N
  MISC_FEATURE (37)..(130): AT LEAST ONE OF X37, X84, X120, AND X130 IS D
  MISC_FEATURE (84)..(84): X84 IS D OR N
  MISC_FEATURE (120)..(120): X120 IS D OR N
  MISC_FEATURE (130)..(130): X130 IS D OR N
MASSLLFLVVGFKCLLVSQAFACKPCFSSSLADIKTXTTAAASFAVLQDISCLRHRDSASEAIRKIPQCRTAIGTPVYVTITAXVTDENYLHSSDLLMLSSCLFYASEMSEKGFKVVFGXVSGIVAVCVXFTSYVQHVKEFTQRSLVVDHVRLLHFMTPETMRWATVLACLFAILLAI

SEQ ID NO: 436 - protein, 70 aa, Artificial Sequence
  SYNTHETIC CONSTRUCT DERIVED FROM HUMAN THOUGHT
  MISC_FEATURE (30)..(30): X30 IS D OR N
  MISC_FEATURE (30)..(51): AT LEAST ONE OF X30, X33, X44, AND X51 IS D
  MISC_FEATURE (33)..(33): X33 IS D OR N
  MISC_FEATURE (44)..(44): X44 IS D OR N
  MISC_FEATURE (51)..(51): X51 IS D OR N
MLEKCLTAGCCSRLLSLWCIVPFCFAVLAXASXDSSSHLQLIYXLTLCELXGTDWLANKFDWAVESFVIF

SEQ ID NO: 437 - protein, 174 aa, Artificial Sequence
  SYNTHETIC CONSTRUCT DERIVED FROM HUMAN THOUGHT
MGSSLDDFCHDSTAPQKVLLAFSITYTPVMIYALKVSRGRLLGLLHLLIFLNCAFTFGYMTFAHFQSTNKVALTMGAVVALLWGVYSAIETWKFITSRCRLCLLGRKYILAPAHHVESAAGFHPIAANDNHAFVVRRPGSTTVDGTLVPGLKSLVLGGRKAVKQGVVNLVKYAK

SEQ ID NO: 438 - protein, 123 aa, Artificial Sequence
  SYNTHETIC CONSTRUCT DERIVED FROM HUMAN THOUGHT
MPNNNGKQQKRKKGDGQPVNQLCQMLGKIIAQQDQSRGKGPGKKNKKKNPEKPHFPLATEDDVRHHFTPSERQLCLSSIQTAFNQGAGTCTLSDSGRISYTVEFSLPTHHTVRLIRVTASPSA

SEQ ID NO: 439 - protein, 296 aa, Artificial Sequence
  SYNTHETIC CONSTRUCT DERIVED FROM HUMAN THOUGHT
VRRESPKHRWCFTINDWTPTEWESIVECGGSIARYLIIGKEVGKSGTPHLQGYVNFKNKRRLSSVKRLPGFGRAHLEPARGSHKEASEYCKKEGDYLEIGEDSSSGTRSDLQAAARILTETSGNLTEVAEKMPAVFIRYGRGLRDFCGVMGLGKPRDFKTEVYVFIGPPGCGKTREACADAAARELQLYFKPRGPWWDGYNGEGAVILDDFYGWVPFDELLRIGDRYPLRVPVKGGFVNFVAKVLYITSNVVPEEWYSSENIRGKLEALFRRFTKVVFWGEGGVKKDMETVYPINY

SEQ ID NO: 440 - protein, 296 aa, Artificial Sequence
  SYNTHETIC CONSTRUCT DERIVED FROM HUMAN THOUGHT
VRRESPKHRWCFTINNWTPTEWESIVECGGSIARYLIIGKEVGKSGTPHLQGYVNFKNKRRLSSVKRLPGFGRAHLEPARGSHKEASEYCKKEGDYLEIGEDSSSGTRSDLQAAARILTETSGDLTEVAEKMPAVFIRYGRGLRDFCGVMGLGKPRDFKTEVYVFIGPPGCGKTREACADAAARELQLYFKPRGPWWDGYNGEGAVILDDFYGWVPFDELLRIGDRYPLRVPVKGGFVNFVAKVLYITSNVVPEEWYSSENIRGKLEALFRRFTKVVFWGEGGVKKDMETVYPINY

SEQ ID NO: 441 - protein, 296 aa, Artificial Sequence; identical to SEQ ID NO: 440
  SYNTHETIC CONSTRUCT DERIVED FROM HUMAN THOUGHT

SEQ ID NO: 442 - protein, 245 aa, Artificial Sequence
  SYNTHETIC CONSTRUCT DERIVED FROM HUMAN THOUGHT
MFKWLMSSLCGIRDSTSPEVYEPIIGGQNPATMLRLQSALAAVNALLPATLTIEDVISSADNTRRLVKAQTLARTYQACQHNIECLSRHRASSDNPNLNAVVTTHMINAKRLSDTCLAALMHLYLSVGAVDATTDTMVDHAIRMTAENSVVMADVAVLEKTLGLDPQATVRAQDLLALNSGVLNSVNAVAEMTDPTDDVEFTQSVHSPLLPRQLSTTEVVGVPSPVKSNLKSKHKPKRKASLVAV

SEQ ID NO: 443 - protein, 497 aa, Artificial Sequence
  SYNTHETIC CONSTRUCT DERIVED FROM HUMAN THOUGHT
MGLFGLLKYAYSNRLVKHDAITTPPGIMTPIAIDLWNVMYTLMEKFDQERNFPLDGAAVTARCFFSLLRLLLKRSYYPIFVSDRGIYGDGRVKQGAKAIVSQTMSSYGGSGRLSSACFTGDEHDTEFQEDPEENDVSVPPQDTCPPTEISAGYVEPERKCEHSSTRWSALDGAPRLSYRLCVNLIRHLGYPYVNACNLEADDVCANLYHTNTVAQIYTTDTDLILMGCDIILDIMPLFPPTLRCCDVLMDLGVTYDEFLTEFVRCHTDLHEPQTLASVQSVISSLHSPPDEDEGADMPQTPSGHSWRCPNERRVISWRRQDDHDYDSSTEDSDQSDSSEEEEECPAGKGFGYRENPAVETCKRRTRPRRSAEASGRILHLKYTSRYPPIMESAPRALVRMAPPKTRHEVLERKFVKHVVSMLTPERRGSLSIMRRLPITQEPSDFSLVHDTLKNLVSEHEIARELANMFWNHIPTPTDYNTVLVNYWDDCGHRRQWS

SEQ ID NO: 444 - protein, 275 aa, Artificial Sequence
  SYNTHETIC CONSTRUCT DERIVED FROM HUMAN THOUGHT
MDSYNYRDFAVGGGLLQRIRLVVSGSLHCGESDATLNDPKHLPARCVFQFSGPDDNSVTFPIEYVLRLMKNWARSQCDPYIRIQNTGVSVLFQGFFFAPPNAPMASITSEHNNVILKSTHTTGLALSGIERVKRGGGLDLRPLQAMMQISCFTRMPVVQLSFRFMGPEDASRTQRLLERATSFGAMELHQKRTVDSCDRSNGIVSPREHRECRERQKRRPTPKRCASEVFASLASISSAFASERVKRRPVRIAAAILAFVFVAVILAIATKGRLF

SEQ ID NO: 445 - protein, 162 aa, Artificial Sequence
  SYNTHETIC CONSTRUCT DERIVED FROM HUMAN THOUGHT
MYGRSNAPGCQPPVRAHPPSSPMTSRLQLAAMEQDASDAALSGMQQARSRQASPKRLRDLIPSSDVESMSLNALDDAYGHHDFSVWFEDLMPPEMELLMPTTDAKLNYLSFTRRLASSVFHSPDNRMPGGACDHTSALDARKERFATIINKFLDLHQILHDA

SEQ ID NO: 446 - protein, 326 aa, Artificial Sequence
  SYNTHETIC CONSTRUCT DERIVED FROM HUMAN THOUGHT
MFDGRSDIYDSTSFAAELDDLYSCRSTGRENGRRSRVSTRGVHRDRCGSAAKRRSTKRRCELVARERDRYSLYLDYMASHPSDEISAVRELVVPLIKTTSITLPFDLDQTVADNCLSLSGMGYYLGIGGCCPTCTVSGEPRLHRADRAALILAYVQQLNNIYEYRGFLASVLAAAAQGDQAGVAASEGVQAERLLENVLAQPELFFAYHVLRDGGIQNVRVLFYRDLSVSGYMMYAVFPTKSVHLHYRLIDRLLAACPGYKIIAHVWQTAFVLVVRRDEGQQTDMDIPTVSAGDIYCKMCDLSFDGELLLEYKKLYAVFDDFLPPV

SEQ ID NO: 447 - protein, 272 aa, Artificial Sequence
  SYNTHETIC CONSTRUCT DERIVED FROM HUMAN THOUGHT
MKRRQRLTARSRLRAGIRCHNRFYNAMVQDLASAKRNGVYGERLAPLFSELVPAETLKTALGVSLAFEVNLGQRRPDCVCTVQFGKGSDAKGVCILIELKTCRFSKNMNTASKNLQRKGGMRQLHDSCRLLARTLPPGSGEIVLAPVLVFVAQRGMRVLRVTRLSPQVVYSNAAVLSCTISRLAEYAPPVSAKSTRRRCVAKGTKAKAFSTKAAAEPVPSITPAQPSAAAAVVSLFPAAVPADTTNAAAVHQPVAVSHVNPLAWAASLFSPK

SEQ ID NO: 448 - protein, 370 aa, Artificial Sequence
  SYNTHETIC CONSTRUCT DERIVED FROM HUMAN THOUGHT
MMAAASDSCLSLWEGSASSPNRQLTPEAVNCLTEALTEDVAVLRLIRSDPRVKIFMAVSVLTPRLARFAPPPPKLTHTAKCAVIMIYLTRPKALALQPKQFHMLVTFNKASVYSLVVRVKTKPFPVGTQRFRAVFQDPEFIGLPSDIPDPAAENIPTEINDRLDVSNFATPAQPPKDKYDCCVLAPGVWWSNANKAIYFLQMDVALLALCPAGWKARGLGIILGRLLNHQEGCATCRFTEHSDPLDATADSVATPESCLCWAPCLWRKAHQRELTVEGDRYLFRVLFMDAVERVRLTGLRRSPKITANLADLVVGIGPHGQQIPVNNAGWKLVALDADISRLIVCGCYALRYICPPTNSKHQPSSPDEYA

SEQ ID NO: 449 - protein, 450 aa, Artificial Sequence
  SYNTHETIC CONSTRUCT DERIVED FROM HUMAN THOUGHT
MARRGAAVAEEPLLPSSGIVGIGPIEGINWRTWLVQVFCFALTTSVLFITLVTASLPQTGYPCFYGSLVDYTQKDHSVVDGVWMRQIAGGVAPTLFLETTSLVAFLYYTTLVLVAISFYLIISAVLVRRYARGKECTAVAGCTRPTTTLIASHVTLVLGTLATWLLQVVILLLSHKQAVLGAAVYVVHFVSLVFFCMSFSGLGTASAQYSSNLRILKTNLPALHKMAGPGRAVMTNLGMGMLGISLPILSLMLGIILANSFHITLWQTVTVAVGVFVALGLMFLIIVELIVSHYVHVLVGPALAVLVASSTLAVATHSYFVHFHAMVSVQAPNLATASKAIVGIMAVISIIMLVVRLVRAIMFHKKRNTEFYGRVKTVSSKARRYANKVRGPRRNPQPLNVAESRGMLLAEDSETDAEEPIYDVVSEEFETEYYDDPQRVPERSHRREYR

SEQ ID NO: 450 - protein, 130 aa, Artificial Sequence
  SYNTHETIC CONSTRUCT DERIVED FROM HUMAN THOUGHT
MSSNSDNTECFGGVNYAEGMRKRKRNPVRDSTFQEYLDARNARYPRSGSTSDSDEDYTTRSKYESDVSEFKKMMDLETLPPPKAEPQAQKAEPDAAKEEPVSTTSYILNEWVAPMIGHFLAMCMYELLFK

SEQ ID NO: 451 - protein, 617 aa, Artificial Sequence
  SYNTHETIC CONSTRUCT DERIVED FROM HUMAN THOUGHT
MLDFHGISLTCAAVASSKVPARCGVTVRDSLKKALMMRGLIPECCAVYRIQDGEKKPIGWDTDISWLTGEELHVEVLENVPLTTHNFVRKTFFTLAFCDFCRKLLFQGFRCQTCGYKFHQRCSTEVPLMCVNYDQLDLLFVSKFFEHHPIPQEEASIAETALTSGSSPSAPPSDSPGPPILTSPSPSKSIPIPQPFRPADEDHRNQFGQRDRSSSAPNVHINTIEPVNIDDLIRDQGFRSDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATEKSRWSGSHQFEQLSGSILWMAPEVIRMQDKNPYSFQSDVYAFGIVLYELMTGQLPYSNINNRDQIIFMVGRGYLSPDLSKVRSNCPKAMKRLMAECLKKKRDERPLFPQILASIELLARSLPKIHRSASEPSLNRAGFQTEDFSLYACASPKTPIQAGGYGEFAAFK

SEQ ID NO: 452 - protein, 763 aa, Canis lupus
MAALSGGGGAEQGQALFNGDMEPEAGAGAAASSAADPAIPEEVWNIKQMIKLTQEHIEALLDKFGGEHNPPSIYLEAYEEYTSKLDALQQREQQLLESLGNGTDFSVSSSASTDTVTSSSSSSLSVLPSSLSVFQNPTDISRSNPKSPQKPIVRVFLPNKQRTVVPARCGVTVRDSLKKALMMRGLIPECCAVYRIQDGEKKPIGWDTDISWLTGEELHVEVLENVPLTTHNFVRKTFFTLAFCDFCRKLLFQGFRCQTCGYKFHQRCSTEVPLMCVNYDQLDLLFVSKFFEHHPIPQEEASIAETALTSGSSPSAPPSDSPGPPILTSPSPSKSIPIPQPFRPADEDHRNQFGQRDRSSSAPNVHINTIEPVNIDDLIRDQGFRSDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQIIFMVGRGYLSPDLSKVRSNCPKAMKRLMAECLKKKRDERPLFPQILASIELLARSLPKIHRSASEPSLNRAGFQTEDFSLYACASPKTPIQAGGYGEFAAFK

SEQ ID NO: 453 - protein, 749 aa, Canis lupus
QALFNGDMEPEAGAGAAASSAADPAIPEEVWNIKQMIKLTQEHIEALLDKFGGEHNPPSIYLEAYEEYTSKLDALQQREQQLLESLGNGTDFSVSSSASTDTVTSSSSSSLSVLPSSLSVFQNPTDISRSNPKSPQKPIVRVFLPNKQRTVVPARCGVTVRDSLKKALMMRGLIPECCAVYRIQDGEKKPIGWDTDISWLTGEELHVEVLENVPLTTRNFVRKTFFTLAFCDFCRKLLFQGFRCQTCGYKFHQRCSTEVPLMCVNYDQLDLLFVSKFFEHHPIPQEEASIAETALTSGSSPSAPPSDSPGPPILTSPSPSKSIPIPQPFRPADEDHRNQFGQRDRSSSAPNVHINTIEPVNIDDLIRDQGFRSDGGSTTGLSATPPASLPGSLTNVKALQKSPGPQRERKSSSSSEDRNRMKTLGRRDSSDDWEIPDGQITVGQRIGSGSFGTVYKGKWHGDVAVKMLNVTAPTPQQLQAFKNEVGVLRKTRHVNILLFMGYSTKPQLAIVTQWCEGSSLYHHLHIIETKFEMIKLIDIARQTAQGMDYLHAKSIIHRDLKSNNIFLHEDLTVKIGDFGLATVKSRWSGSHQFEQLSGSILWMAPEVIRMQDKNPYSFQSDVYAFGIVLYELMTGQLPYSNINNRDQIIFMVGRGYLSPDLSKVRSNCPKAMKRLMAECLKKKRDERPLFPQILASIELLARSLPKIHRSASEPSLNRAGFQTEDFSLYACASPKTPIQAGGYGAFPVH

SEQ ID NO: 454 - protein, 766 aa, Homo sapiens [sequence omitted]

SEQ ID NO: 455 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 456 - protein, 180 aa, Homo sapiens
MQAEGRGTGGSTGDADGPGGPGIPDGPGGNAGGPGEAGATGGRGPRGAGAARASGPGGGAPRGPHGGAASGLNGCCRCGARGPESRLLEFYLAMPFATPMEAELARRSLAQDAPPLPVPGVLLKEFTVSGNILTIRLTAADHRQLQLSISSCLQQLSLLMWITQCFLPVFLAQPPSGQRR

SEQ ID NO: 457 - protein, 1259 aa, Canis lupus
MELAAWCRWGLLLALLPSGAAGTQVCTGTDMKLRLPASPETHLDMLRHLYQGCQVVQGNLELTYLPANASLSFLQDIQEVQGYVLIAHSQVRQIPLQRLRIVRGTQLFEDNYALAVLDNGDPLEGGIPAPGAAQGGLRELQLRSLTEILKGGVLIQRSPQLCHQDTILWKDVFHKNNQLALTLIDTNRFSACPPCSPACKDAHCWGASSGDCQSLTRTVCAGGCARCKGPQPTDCCHEQCAAGCTGPKHSDCLACLHFNHSGICELHCPALVTYNTDTFESMPNPEGRYTFGASCVTSCPYNYLSTDVGSCTLVCPLNNQEVTAEDGTQRCEKCSKPCARVCYGLGMEHLREVRAVTSANIQEFAGCKKIFGSLAFLPESFDGDPASNTAPLQPEQLRVFEALEEITGYLYISAWPDSLPNLSVFQNLRVIRGRVLHDGAYSLTLQGLGISWLGLRSLRELGSGLALIHRNARLCFVHTVPWDQLFRNPHQALLHSANRPEEECVGEGLACYPCAHGHCWGPGPTQCVNCSQFLRGQECVEECRVLQGLPREYVKDRYCLPCHSECQPQNGSVTCFGSEADQCVACAHYKDPPFCVARCPSGVKPDLSFMPIWKFADEEGTCQPCPINCTHSCADLDEKGCPAEQRASPVTSIIAAVVGILLAVVVGLVLGILIKRRRQKIRKYTMRRLLQETELVEPLTPSGAMPNQAQMRILKETELRKVKVLGSGAFGTVYKGIWIPDGENVKIPVAIKVLRENTSPKANKEILDEAYVMAGVGSPYVSRLLGICLTSTVQLVTQLMPYGCLLDHVREHRGRLGSQDLLNWCVQIAKGMSYLEDVRLVHRDLAARNVLVKSPNHVKITDFGLARLLDIDETEYHADGGKVPIKWMALESIPPRRFTHQSDVWSYGVTVWELMTFGAKPYDGIPAREIPDLLEKGERLPQPPICTIDVYMIMVKCWMIDSECRPRFRELVAEFSRMARDPQRFVVIQNEDLGPASPLDSTFYRSLLEDDDMGDLVDAEEYLVPQQGFFCPEPTPGAGGTAHRRHRSSSTRNGGGELTLGLEPSEEEPPKSPLAPSEGAGSDVFDGDLGMGAAKGLQSLPSQDPSPLQRYSEDPTVPLPPETDGKVAPLTCSPQPEYVNQPEVWPQPPLALEGPLPPSRPAGATLERPKTLSPKTLSPGKNGVVKDVFAFGSAVENPEYLAPRGRAAPQPHPPPAFSPAFDNLYYWDQDPSERGSPPSTFEGTPTAENPEYLGLDVPV

SEQ ID NO: 458 - protein, 13 aa, Artificial Sequence
  SYNTHETIC CONSTRUCT DERIVED FROM HUMAN THOUGHT
GCCGCCACCATGG

SEQ ID NO: 459 - protein, 5 aa, Artificial Sequence
  SYNTHETIC CONSTRUCT DERIVED FROM HUMAN THOUGHT
GGGGS

SEQ ID NO: 460 - protein, 4 aa, Artificial Sequence
  SYNTHETIC CONSTRUCT DERIVED FROM HUMAN THOUGHT
GGGS

SEQ ID NO: 461 - protein, 4 aa, Artificial Sequence
  SYNTHETIC CONSTRUCT DERIVED FROM HUMAN THOUGHT
SGGG

SEQ ID NO: 462 - protein, 11 aa, Artificial Sequence
  SYNTHETIC CONSTRUCT DERIVED FROM HUMAN THOUGHT
GSGGGTGGGSG

SEQ ID NO: 463 - protein, 6 aa, Artificial Sequence
  SYNTHETIC CONSTRUCT DERIVED FROM HUMAN THOUGHT
GSGSGS

SEQ ID NO: 464 - protein, 10 aa, Artificial Sequence
  SYNTHETIC CONSTRUCT DERIVED FROM HUMAN THOUGHT
GSGSGSGSGS

SEQ ID NO: 465 - protein, 8 aa, Artificial Sequence
  SYNTHETIC CONSTRUCT DERIVED FROM HUMAN THOUGHT
GGGSGGGS

SEQ ID NO: 466 - protein, 10 aa, Artificial Sequence
  SYNTHETIC CONSTRUCT DERIVED FROM HUMAN THOUGHT
GGGGSGGGGS

SEQ ID NO: 467 - protein, 13 aa, Artificial Sequence
  SYNTHETIC CONSTRUCT DERIVED FROM HUMAN THOUGHT
GGGSGGGGSGGGS

SEQ ID NO: 468 - protein, 4 aa, Artificial Sequence
  SYNTHETIC CONSTRUCT DERIVED FROM HUMAN THOUGHT
GGSG

SEQ ID NO: 469 - protein, 8 aa, Artificial Sequence
  SYNTHETIC CONSTRUCT DERIVED FROM HUMAN THOUGHT
GGSGGGSG

SEQ ID NO: 470 - protein, 12 aa, Artificial Sequence
  SYNTHETIC CONSTRUCT DERIVED FROM HUMAN THOUGHT
GGSGGGSGGGSG

SEQ ID NO: 471 - protein, 6 aa, Artificial Sequence
  SYNTHETIC CONSTRUCT DERIVED FROM HUMAN THOUGHT
GGSGGS

SEQ ID NO: 472 - protein, 5 aa, Artificial Sequence
  SYNTHETIC CONSTRUCT DERIVED FROM HUMAN THOUGHT
SGGGG

SEQ ID NO: 473 - protein, 12 aa, Artificial Sequence
  SYNTHETIC CONSTRUCT DERIVED FROM HUMAN THOUGHT
SGGGGSGGGGIG

SEQ ID NO: 474 - protein, 10 aa, Artificial Sequence
  SYNTHETIC CONSTRUCT DERIVED FROM HUMAN THOUGHT
SGGGGSGGGG

SEQ ID NO: 475 - protein, 4 aa, Artificial Sequence
  SYNTHETIC CONSTRUCT DERIVED FROM HUMAN THOUGHT
AAAA

SEQ ID NO: 476 - protein, 5 aa, Artificial Sequence
  SYNTHETIC CONSTRUCT DERIVED FROM HUMAN THOUGHT
EAAAK

SEQ ID NO: 477 - protein, 12 aa, Artificial Sequence
  SYNTHETIC CONSTRUCT DERIVED FROM HUMAN THOUGHT
AEAAAKEAAAKA

SEQ ID NO: 478 - protein, 13 aa, Artificial Sequence
  SYNTHETIC CONSTRUCT DERIVED FROM HUMAN THOUGHT
EAEAAAKEAAAKA

SEQ ID NO: 479 - protein, 7 aa, Artificial Sequence
  SYNTHETIC CONSTRUCT DERIVED FROM HUMAN THOUGHT
EPKSCDK

SEQ ID NO: 480 - protein, 7 aa, Artificial Sequence
  SYNTHETIC CONSTRUCT DERIVED FROM HUMAN THOUGHT
IEGRDMD

SEQ ID NO: 481 - protein, 5 aa, Artificial Sequence
  SYNTHETIC CONSTRUCT DERIVED FROM HUMAN THOUGHT
PAPAP

SEQ ID NO: 482 - protein, 23 aa, Artificial Sequence
  SYNTHETIC CONSTRUCT DERIVED FROM HUMAN THOUGHT
ITPNGSIPNDKPFQNVNKITYGA

SEQ ID NO: 483 - protein, 4 aa, Artificial Sequence
  SYNTHETIC CONSTRUCT DERIVED FROM HUMAN THOUGHT
GFLG

SEQ ID NO: 484 - protein, 4 aa, Artificial Sequence
  SYNTHETIC CONSTRUCT DERIVED FROM HUMAN THOUGHT
ALAL

SEQ ID NO: 485 - protein, 9 aa, Artificial Sequence
  SYNTHETIC CONSTRUCT DERIVED FROM HUMAN THOUGHT
VDGGSGGGS

SEQ ID NO: 486 - protein, 16 aa, Artificial Sequence
  SYNTHETIC CONSTRUCT DERIVED FROM HUMAN THOUGHT
GGGGSLVPRGSGGGGS

SEQ ID NO: 487 - protein, 12 aa, Artificial Sequence
  SYNTHETIC CONSTRUCT DERIVED FROM HUMAN THOUGHT
SGGGGSGGGGIG

SEQ ID NO: 488 - protein, 4 aa, Artificial Sequence
  SYNTHETIC CONSTRUCT DERIVED FROM HUMAN THOUGHT
RVKR

SEQ ID NO: 489 - protein, 4 aa, Artificial Sequence
  SYNTHETIC CONSTRUCT DERIVED FROM HUMAN THOUGHT
VRVV

SEQ ID NO: 490 - protein, 25 aa, Artificial Sequence
  SYNTHETIC CONSTRUCT DERIVED FROM HUMAN THOUGHT
SSVSPTTSVHPTPTSVPPTPTKSSP

SEQ ID NO: 491 - protein, 25 aa, Artificial Sequence
  SYNTHETIC CONSTRUCT DERIVED FROM HUMAN THOUGHT
PTSTPADSSTITPTATPTATPTIKG

SEQ ID NO: 492 - protein, 25 aa, Artificial Sequence
  SYNTHETIC CONSTRUCT DERIVED FROM HUMAN THOUGHT
TVTPTATATPSAIVTTITPTATTKP

SEQ ID NO: 493 - protein, 25 aa, Artificial Sequence
  SYNTHETIC CONSTRUCT DERIVED FROM HUMAN THOUGHT
TNGSITVAATAPTVTPTVNATPSAA

SEQ ID NO: 494 - protein, 17 aa, Homo sapiens
VSQTSKLTRAETVFPDV

SEQ ID NO: 495 - protein, 6 aa, Homo sapiens
PLGLWA

SEQ ID NO: 496 - protein, 10 aa, Homo sapiens
EDVVCCSMSY

SEQ ID NO: 497 - protein, 8 aa, Homo sapiens
GGIEGRGS

SEQ ID NO: 498 - protein, 10 aa, Homo sapiens
TRHRQPRGWE

SEQ ID NO: 499 - protein, 10 aa, Homo sapiens
AGNRVRRSVG

SEQ ID NO: 500 - protein, 9 aa, Homo sapiens
RRRRRRRRR

SEQ ID NO: 501 - protein, 4 aa, Homo sapiens
GFLG

SEQ ID NO: 502 - protein, 4 aa, Homo sapiens
IEGR

SEQ ID NO: 503 - protein, 6 aa, Homo sapiens
LVPRGS

SEQ ID NO: 504 - protein, 5 aa, Homo sapiens
VIAGR

SEQ ID NO: 505 - protein, 19 aa, porcine teschovirus-1 2A
ATNFSLLKQAGDVEENPGP

SEQ ID NO: 506 - protein, 20 aa, equine rhinitis A virus
QCTNYALLKLAGDVESNPGP

SEQ ID NO: 507 - protein, 22 aa, foot-and-mouth disease virus 18
VKQTLNFDLLKLAGDVESNPGP

SEQ ID NO: 508 - protein, 18 aa, thosea asigna virus 2A
EGRGSLLTCGDVEENPGP

SEQ ID NO: 509 - protein, 5 aa, Homo sapiens
KKKRK

SEQ ID NO: 510 - protein, 26 aa, Homo sapiens
MLRTSSLFTRRVQPSLFRNILRLQST

SEQ ID NO: 511 - protein, 4 aa, Homo sapiens
KDEL

SEQ ID NO: 512 - protein, 4 aa, Artificial Sequence
  SYNTHETIC CONSTRUCT DERIVED FROM HUMAN THOUGHT
  MISC_FEATURE (4)..(4): X is any amino acid
CAAX

SEQ ID NO: 513 - protein, 4 aa, Artificial Sequence
  SYNTHETIC CONSTRUCT DERIVED FROM HUMAN THOUGHT
  MISC_FEATURE (3)..(3): X3 IS ANY AMINO ACID
  MISC_FEATURE (4)..(4): X4 IS ANY AMINO ACID
CCXX

SEQ ID NO: 514 - protein, 5 aa, Homo sapiens
KFERQ

SEQ ID NO: 515 - protein, 4 aa, Artificial Sequence
  SYNTHETIC CONSTRUCT DERIVED FROM HUMAN THOUGHT
  MISC_FEATURE (3)..(3): X3 is any amino acid
  MISC_FEATURE (4)..(4): X4 is any amino acid
KKXX

SEQ ID NO: 516 - protein, 4 aa, Homo sapiens
YQRL

SEQ ID NO: 517 - protein, 47 aa, Artificial Sequence
  SYNTHETIC CONSTRUCT DERIVED FROM HUMAN THOUGHT
LEIRAAFLRQRNTALRTEVAELEQEVQRLENEVSQYETRYGPLGGGK

SEQ ID NO: 518 - protein, 47 aa, Artificial Sequence
  SYNTHETIC CONSTRUCT DERIVED FROM HUMAN THOUGHT
LEIEAAFLERENTALETRVAELRQRVQRLRNRVSQYRTRYGPLGGGK

SEQ ID NO: 519 - protein, 33 aa, Artificial Sequence
  SYNTHETIC CONSTRUCT DERIVED FROM HUMAN THOUGHT
RMKQIEDKIEEILSKIYHIENEIARIKKLIGER

SEQ ID NO: 520 - protein, 32 aa, Artificial Sequence
  SYNTHETIC CONSTRUCT DERIVED FROM HUMAN THOUGHT
LSSIEKKQEEQTSWLIWISNELTLIRNELAQS

SEQ ID NO: 521 - protein, 34 aa, Artificial Sequence
  SYNTHETIC CONSTRUCT DERIVED FROM HUMAN THOUGHT
MKQIEDKIEEILSKIYHIENEIARIKKLIGERAG

SEQ ID NO: 522 - protein, 31 aa, Artificial Sequence
  SYNTHETIC CONSTRUCT DERIVED FROM HUMAN THOUGHT
LSSIEKKLEEITSQLIQISNELTLIRNELAQ

SEQ ID NO: 523 - protein, 31 aa, Artificial Sequence
  SYNTHETIC CONSTRUCT DERIVED FROM HUMAN THOUGHT
LSSIEKKLEEITSQLQQIRNELTLIRNELAQ

SEQ ID NO: 524 - protein, 31 aa, Artificial Sequence
  SYNTHETIC CONSTRUCT DERIVED FROM HUMAN THOUGHT
LSSLEKKLEELTSQLIQLRNELTLLRNELAQ

SEQ ID NO: 525 - protein, 31 aa, Artificial Sequence
  SYNTHETIC CONSTRUCT DERIVED FROM HUMAN THOUGHT
ISSLEKKIEELTSQIQQLRNEITLLRNEIAQ

SEQ ID NO: 526 - protein, 47 aa, Artificial Sequence; identical to SEQ ID NO: 518
  SYNTHETIC CONSTRUCT DERIVED FROM HUMAN THOUGHT

SEQ ID NO: 527 - protein, 64 aa, Artificial Sequence
  SYNTHETIC CONSTRUCT DERIVED FROM HUMAN THOUGHT
VTAFSNMDDMLQKAHLVIEGTFIYLRDSTEFFIRVRDGWKKLQLGELIPIPADSPPPPALSSNP

SEQ ID NO: 528 - protein, 31 aa, Artificial Sequence
  SYNTHETIC CONSTRUCT DERIVED FROM HUMAN THOUGHT
LKSVENRLAVVENQLKTVIEELKTVKDLLSN

SEQ ID NO: 529 - protein, 31 aa, Artificial Sequence
  SYNTHETIC CONSTRUCT DERIVED FROM HUMAN THOUGHT
LARIEEKLKTIKAQLSEIASTLNMIREQLAQ

SEQ ID NO: 530 - protein, 31 aa, Artificial Sequence
  SYNTHETIC CONSTRUCT DERIVED FROM HUMAN THOUGHT
VSRLEEKVKTLKSQVTELASTVSLLREQVAQ

SEQ ID NO: 531 - protein, 30 aa, Artificial Sequence
  SYNTHETIC CONSTRUCT DERIVED FROM HUMAN THOUGHT
IQSEKKIEDISSLIGQIQSEITLIRNEIAQ

SEQ ID NO: 532 - protein, 31 aa, Artificial Sequence
  SYNTHETIC CONSTRUCT DERIVED FROM HUMAN THOUGHT
LMSLEKKLEELTQTLMQLQNELSMLKNELAQ

SEQ ID NO: 533 - protein, 157 aa, Homo sapiens
VRSSSRTPSDKPVAHVVANPQAEGQLQWLNRRANALLANGVELRDNQLVVPSEGLYLIYSQVLFKGQGCPSTHVLLTHTISRIAVSSQTKVNLLSAIKSPCQRETPEGAEAKPWYEPIYLGGVFQLEKGDRLSAEINRPDYLDFAESGQVYFGIIAL

SEQ ID NO: 534 - protein, 40 aa, Artificial Sequence
  SYNTHETIC CONSTRUCT DERIVED FROM HUMAN THOUGHT
SHGFPPEVEEQDDGTLPMSCAQESGMDRHPAACASARINV

SEQ ID NO: 535 - protein, 17 aa, Artificial Sequence
  SYNTHETIC CONSTRUCT DERIVED FROM HUMAN THOUGHT
HNPSERLPLAQVSAHPW

SEQ ID NO: 536 - protein, 17 aa, Artificial Sequence
  SYNTHETIC CONSTRUCT DERIVED FROM HUMAN THOUGHT
LCSKLRNLLHDNELSDL

SEQ ID NO: 537 - protein, 17 aa, Artificial Sequence
  SYNTHETIC CONSTRUCT DERIVED FROM HUMAN THOUGHT
AWAHSRAALDRLEKLLR

SEQ ID NO: 538 - protein, 17 aa, Artificial Sequence
  SYNTHETIC CONSTRUCT DERIVED FROM HUMAN THOUGHT
FIFMRRSSLLSRSSSGY

SEQ ID NO: 539 - protein, 17 aa, Artificial Sequence
  SYNTHETIC CONSTRUCT DERIVED FROM HUMAN THOUGHT
GPFATRSPLFIFMRRSS

SEQ ID NO: 540 - protein, 17 aa, Artificial Sequence
  SYNTHETIC CONSTRUCT DERIVED FROM HUMAN THOUGHT
SSVPQRSTLAELKSKGK

SEQ ID NO: 541 - protein, 15 aa, Artificial Sequence
  SYNTHETIC CONSTRUCT DERIVED FROM HUMAN THOUGHT
QQPRTRAALAVLKSG

SEQ ID NO: 542 - protein, 17 aa, Artificial Sequence
  SYNTHETIC CONSTRUCT DERIVED FROM HUMAN THOUGHT
PGLRPRTALGDIGNKVS

SEQ ID NO: 543 - protein, 17 aa, Artificial Sequence
  SYNTHETIC CONSTRUCT DERIVED FROM HUMAN THOUGHT
GALKKRSAFEDLTNASQ

SEQ ID NO: 544 - protein, 17 aa, Artificial Sequence
  SYNTHETIC CONSTRUCT DERIVED FROM HUMAN THOUGHT
LPLSPRKRLGDDNLCNT

SEQ ID NO: 545 - protein, 17 aa, Artificial Sequence
  SYNTHETIC CONSTRUCT DERIVED FROM HUMAN THOUGHT
SKVLGRSPLTILQDDNS

SEQ ID NO: 546 - protein, 17 aa, Artificial Sequence
  SYNTHETIC CONSTRUCT DERIVED FROM HUMAN THOUGHT
GPRRGRDELGGGRRPGT

SEQ ID NO: 547 - protein, 17 aa, Artificial Sequence
  SYNTHETIC CONSTRUCT DERIVED FROM HUMAN THOUGHT
TKIAHRKSLSQKENRHK

SEQ ID NO: 548 - protein, 17 aa, Artificial Sequence
  SYNTHETIC CONSTRUCT DERIVED FROM HUMAN THOUGHT
VTCLLRKRLPVTNEMVH

SEQ ID NO: 549 - protein, 17 aa, Artificial Sequence
  SYNTHETIC CONSTRUCT DERIVED FROM HUMAN THOUGHT
LEIRDRMWLKITIANAV

SEQ ID NO: 550 - protein, 17 aa, Artificial Sequence
  SYNTHETIC CONSTRUCT DERIVED FROM HUMAN THOUGHT
VANSYRGTLKRQPAFDT

SEQ ID NO: 551 - protein, 17 aa, Artificial Sequence
  SYNTHETIC CONSTRUCT DERIVED FROM HUMAN THOUGHT
RQFQRRLPLRAVNLRAG

SEQ ID NO: 552 - protein, 17 aa, Artificial Sequence
  SYNTHETIC CONSTRUCT DERIVED FROM HUMAN THOUGHT
DKKRPRRSLSISKNKKK

SEQ ID NO: 553 - protein, 17 aa, Artificial Sequence
  SYNTHETIC CONSTRUCT DERIVED FROM HUMAN THOUGHT
EYVMFRTPLASVQKSAA

SEQ ID NO: 554 - protein, 16 aa, Artificial Sequence
  SYNTHETIC CONSTRUCT DERIVED FROM HUMAN THOUGHT
EYVMFRTPLASVQKSA

SEQ ID NO: 555 - protein, 17 aa, Artificial Sequence
  SYNTHETIC CONSTRUCT DERIVED FROM HUMAN THOUGHT
NSSVPRRTLKMIQPSAS

SEQ ID NO: 556 - protein, 17 aa, Artificial Sequence
  SYNTHETIC CONSTRUCT DERIVED FROM HUMAN THOUGHT
FVLQLRPELQDALISII

SEQ ID NO: 557 - protein, 17 aa, Artificial Sequence
  SYNTHETIC CONSTRUCT DERIVED FROM HUMAN THOUGHT
EHAAFRFALSQLTEPPK

SEQ ID NO: 558 - protein, 17 aa, Artificial Sequence
  SYNTHETIC CONSTRUCT DERIVED FROM HUMAN THOUGHT
EVWQRRGSLEGAAAAAE

SEQ ID NO: 559 - protein, 17 aa, Artificial Sequence
  SYNTHETIC CONSTRUCT DERIVED FROM HUMAN THOUGHT
ENFALKTPLKEGNTNCY

SEQ ID NO: 560 - protein, 17 aa, Artificial Sequence
  SYNTHETIC CONSTRUCT DERIVED FROM HUMAN THOUGHT
EVSKLRCQLAKKKQSET

SEQ ID NO: 561 - protein, 17 aa, Artificial Sequence
  SYNTHETIC CONSTRUCT DERIVED FROM HUMAN THOUGHT
WFQNRRMKLKKMNRENR

SEQ ID NO: 562 - protein, 17 aa, Artificial Sequence
  SYNTHETIC CONSTRUCT DERIVED FROM HUMAN THOUGHT
APFEQRASLNPRAEHLE

SEQ ID NO: 563 - protein, 17 aa, Artificial Sequence
  SYNTHETIC CONSTRUCT DERIVED FROM HUMAN THOUGHT
SLLKERKFLSLASNPEL

SEQ ID NO: 564 - protein, 17 aa, Artificial Sequence
  SYNTHETIC CONSTRUCT DERIVED FROM HUMAN THOUGHT
LDPSNRKPLTVLNKGLE

SEQ ID NO: 565 - protein, 17 aa, Artificial Sequence
  SYNTHETIC CONSTRUCT DERIVED FROM HUMAN THOUGHT
LPKATRKALGTVNRATE

SEQ ID NO: 566 - protein, 17 aa, Artificial Sequence
  SYNTHETIC CONSTRUCT DERIVED FROM HUMAN THOUGHT
VGGEKRLCLPQVLNSVL

SEQ ID NO: 567 - protein, 14 aa, Artificial Sequence
  SYNTHETIC CONSTRUCT DERIVED FROM HUMAN THOUGHT
MHRKHLQEIPDLSS

SEQ ID NO: 568 - protein, 13 aa, Artificial Sequence
  SYNTHETIC CONSTRUCT DERIVED FROM HUMAN THOUGHT
GGEAQKENGIYSV

SEQ ID NO: 569 - protein, 13 aa, Artificial Sequence
  SYNTHETIC SEQUENCE DERIVED FROM HUMAN THOUGHT
HILEDKENVVAKQ

SEQ ID NO: 570 - protein, 13 aa, Artificial Sequence
  SYNTHETIC CONSTRUCT DERIVED FROM HUMAN THOUGHT
FEDGNKENYGLPQ

SEQ ID NO: 571 - protein, 13 aa, Artificial Sequence
  SYNTHETIC CONSTRUCT DERIVED FROM HUMAN THOUGHT
PMPRAKENELQAG

SEQ ID NO: 572 - protein, 13 aa, Artificial Sequence
  SYNTHETIC CONSTRUCT DERIVED FROM HUMAN THOUGHT
EWELSKENVQPLR

SEQ ID NO: 573 - protein, 13 aa, Artificial Sequence
  SYNTHETIC CONSTRUCT DERIVED FROM HUMAN THOUGHT
SFLLSKENQPENS

SEQ ID NO: 574 - protein, 13 aa, Artificial Sequence
  SYNTHETIC CONSTRUCT DERIVED FROM HUMAN THOUGHT
DPDENKENEAFEF

SEQ ID NO: 575 - protein, 13 aa, Artificial Sequence
  SYNTHETIC CONSTRUCT DERIVED FROM HUMAN THOUGHT
SSGEDKENDGFVF

SEQ ID NO: 576 - protein, 13 aa, Artificial Sequence
  SYNTHETIC CONSTRUCT DERIVED FROM HUMAN THOUGHT
SSSANKENDNGNL

SEQ ID NO: 577 - protein, 13 aa, Artificial Sequence
  SYNTHETIC CONSTRUCT DERIVED FROM HUMAN THOUGHT
PKQGKKENGPPHS

SEQ ID NO: 578 - protein, 13 aa, Artificial Sequence
  SYNTHETIC CONSTRUCT DERIVED FROM HUMAN THOUGHT
ENSSQKENVFKCD

SEQ ID NO: 579 - protein, 13 aa, Artificial Sequence
  SYNTHETIC CONSTRUCT DERIVED FROM HUMAN THOUGHT
QEMEEKENCHLEQ

SEQ ID NO: 580 - protein, 13 aa, Artificial Sequence
  SYNTHETIC CONSTRUCT DERIVED FROM HUMAN THOUGHT
DVILLKENSTAFE

SEQ ID NO: 581 - protein, 13 aa, Artificial Sequence
  SYNTHETIC CONSTRUCT DERIVED FROM HUMAN THOUGHT
SHGKDKENRGINT

SEQ ID NO: 582 - protein, 13 aa, Artificial Sequence
  SYNTHETIC CONSTRUCT DERIVED FROM HUMAN THOUGHT
QKAEEKENHCPTM

SEQ ID NO: 583 - protein, 13 aa, Artificial Sequence
  SYNTHETIC CONSTRUCT DERIVED FROM HUMAN THOUGHT
FSGESKENIMRSE

SEQ ID NO: 584 - protein, 13 aa, Artificial Sequence
  SYNTHETIC CONSTRUCT DERIVED FROM HUMAN THOUGHT
LTLALKENSRLQK

SEQ ID NO: 585 - protein, 13 aa, Artificial Sequence
  SYNTHETIC CONSTRUCT DERIVED FROM HUMAN THOUGHT
PWGQSKENNYLNQ

SEQ ID NO: 586 - protein, 13 aa, Artificial Sequence
  SYNTHETIC CONSTRUCT DERIVED FROM HUMAN THOUGHT
PKDSEKENQIPEE

SEQ ID NO: 587 - protein, 13 aa, Artificial Sequence
  SYNTHETIC CONSTRUCT DERIVED FROM HUMAN THOUGHT
ILHFAKENDFKAF

SEQ ID NO: 588 - protein, 13 aa, Artificial Sequence
  SYNTHETIC CONSTRUCT DERIVED FROM HUMAN THOUGHT
TQHPEKENEGDIT

SEQ ID NO: 589 - protein, 13 aa, Artificial Sequence
  SYNTHETIC CONSTRUCT DERIVED FROM HUMAN THOUGHT
AGPDNKENCPVPG

SEQ ID NO: 590 - protein, 16 aa, Artificial Sequence
  SYNTHETIC CONSTRUCT DERIVED FROM HUMAN THOUGHT
SLSSAFHVFEDGNKEN

SEQ ID NO: 591 - protein, 16 aa, Artificial Sequence
  SYNTHETIC CONSTRUCT DERIVED FROM HUMAN THOUGHT
GPSVPFSIFDEFLLSE

SEQ ID NO: 592 - protein, 16 aa, Artificial Sequence
  SYNTHETIC CONSTRUCT DERIVED FROM HUMAN THOUGHT
QNNSRITVFDENADEA

SEQ ID NO: 593 - protein, 16 aa, Artificial Sequence
  SYNTHETIC CONSTRUCT DERIVED FROM HUMAN THOUGHT
AVLPSFTPYVEETARQ

SEQ ID NO: 594 - protein, 16 aa, Artificial Sequence
  SYNTHETIC CONSTRUCT DERIVED FROM HUMAN THOUGHT
SKQPAFTIHVDEAEKE

SEQ ID NO: 595 - protein, 7 aa, Artificial Sequence
  SYNTHETIC CONSTRUCT DERIVED FROM HUMAN THOUGHT
ISKGNLR

SEQ ID NO: 596 - protein, 7 aa, Artificial Sequence
  SYNTHETIC CONSTRUCT DERIVED FROM HUMAN THOUGHT
RQILGMR

SEQ ID NO: 597 - protein, 12 aa, Artificial Sequence
  SYNTHETIC CONSTRUCT DERIVED FROM HUMAN THOUGHT
GTKKSKKNLRRL

SEQ ID NO: 598 - protein, 4 aa, Artificial Sequence
  SYNTHETIC CONSTRUCT DERIVED FROM HUMAN THOUGHT
HDEF

SEQ ID NO: 599 - protein, 4 aa, Artificial Sequence
  SYNTHETIC CONSTRUCT DERIVED FROM HUMAN THOUGHT
HDEL

SEQ ID NO: 600 - protein, 4 aa, Artificial Sequence
  SYNTHETIC CONSTRUCT DERIVED FROM HUMAN THOUGHT
RDEF

SEQ ID NO: 601 - protein, 4 aa, Artificial Sequence
  SYNTHETIC CONSTRUCT DERIVED FROM HUMAN THOUGHT
RDEL

SEQ ID NO: 602 - protein, 4 aa, Artificial Sequence
  SYNTHETIC CONSTRUCT DERIVED FROM HUMAN THOUGHT
WDEL

SEQ ID NO: 603 - protein, 4 aa, Artificial Sequence
  SYNTHETIC CONSTRUCT DERIVED FROM HUMAN THOUGHT
YDEL

SEQ ID NO: 604 - protein, 4 aa, Artificial Sequence
  SYNTHETIC CONSTRUCT DERIVED FROM HUMAN THOUGHT
HEEF

SEQ ID NO: 605 - protein, 4 aa, Artificial Sequence
  SYNTHETIC CONSTRUCT DERIVED FROM HUMAN THOUGHT
HEEL

SEQ ID NO: 606 - protein, 4 aa, Artificial Sequence
  SYNTHETIC CONSTRUCT DERIVED FROM HUMAN THOUGHT
KEEL

SEQ ID NO: 607 - protein, 4 aa, Artificial Sequence
  SYNTHETIC CONSTRUCT DERIVED FROM HUMAN THOUGHT
REEL

SEQ ID NO: 608 - protein, 4 aa, Artificial Sequence
  SYNTHETIC CONSTRUCT DERIVED FROM HUMAN THOUGHT
KAEL

SEQ ID NO: 609 - protein, 4 aa, Artificial Sequence
  SYNTHETIC CONSTRUCT DERIVED FROM HUMAN THOUGHT
KCEL

SEQ ID NO: 610 - protein, 4 aa, Artificial Sequence
  SYNTHETIC CONSTRUCT DERIVED FROM HUMAN THOUGHT
KFEL

SEQ ID NO: 611 - protein, 4 aa, Artificial Sequence
  SYNTHETIC CONSTRUCT DERIVED FROM HUMAN THOUGHT
KGEL

SEQ ID NO: 612 - protein, 4 aa, Artificial Sequence
  SYNTHETIC CONSTRUCT DERIVED FROM HUMAN THOUGHT
KHEL

SEQ ID NO: 613 - protein, 4 aa, Artificial Sequence
  SYNTHETIC CONSTRUCT DERIVED FROM HUMAN THOUGHT
KLEL

SEQ ID NO: 614 - protein, 4 aa, Artificial Sequence
  SYNTHETIC CONSTRUCT DERIVED FROM HUMAN THOUGHT
KNEL

SEQ ID NO: 615 - protein, 4 aa, Artificial Sequence
  SYNTHETIC CONSTRUCT DERIVED FROM HUMAN THOUGHT
KQEL

SEQ ID NO: 616 - protein, 4 aa, Artificial Sequence
  SYNTHETIC CONSTRUCT DERIVED FROM HUMAN THOUGHT
KREL

SEQ ID NO: 617 - protein, 4 aa, Artificial Sequence
  SYNTHETIC CONSTRUCT DERIVED FROM HUMAN THOUGHT
KSEL

SEQ ID NO: 618 - protein, 4 aa, Artificial Sequence
  SYNTHETIC CONSTRUCT DERIVED FROM HUMAN THOUGHT
KVEL

SEQ ID NO: 619 - protein, 4 aa, Artificial Sequence
  SYNTHETIC CONSTRUCT DERIVED FROM HUMAN THOUGHT
KWEL

SEQ ID NO: 620 - protein, 4 aa, Artificial Sequence
  SYNTHETIC CONSTRUCT DERIVED FROM HUMAN THOUGHT
KYEL

SEQ ID NO: 621 - protein, 4 aa, Artificial Sequence
  SYNTHETIC CONSTRUCT DERIVED FROM HUMAN THOUGHT
KEDL

SEQ ID NO: 622 - protein, 4 aa, Artificial Sequence
  SYNTHETIC CONSTRUCT DERIVED FROM HUMAN THOUGHT
KIEL

SEQ ID NO: 623 - protein, 4 aa, Artificial Sequence
  SYNTHETIC CONSTRUCT DERIVED FROM HUMAN THOUGHT
DKEL

SEQ ID NO: 624 - protein, 4 aa, Artificial Sequence
  SYNTHETIC CONSTRUCT DERIVED FROM HUMAN THOUGHT
FDEL

SEQ ID NO: 625 - protein, 4 aa, Artificial Sequence
  SYNTHETIC CONSTRUCT DERIVED FROM HUMAN THOUGHT
KDEF

SEQ ID NO: 626 - protein, 4 aa, Artificial Sequence
  SYNTHETIC CONSTRUCT DERIVED FROM HUMAN THOUGHT
KKEL

SEQ ID NO: 627 - protein, 4 aa, Artificial Sequence
  SYNTHETIC CONSTRUCT DERIVED FROM HUMAN THOUGHT
HADL

SEQ ID NO: 628 - protein, 4 aa, Artificial Sequence
  SYNTHETIC CONSTRUCT DERIVED FROM HUMAN THOUGHT
HAEL

SEQ ID NO: 629 - protein, 4 aa, Artificial Sequence
  SYNTHETIC CONSTRUCT DERIVED FROM HUMAN THOUGHT
HIEL

SEQ ID NO: 630 - protein, 4 aa, Artificial Sequence
  SYNTHETIC CONSTRUCT DERIVED FROM HUMAN THOUGHT
HNEL

SEQ ID NO: 631 - protein, 4 aa, Artificial Sequence
  SYNTHETIC CONSTRUCT DERIVED FROM HUMAN THOUGHT
HTEL

SEQ ID NO: 632 - protein, 4 aa, Artificial Sequence
  SYNTHETIC CONSTRUCT DERIVED FROM HUMAN THOUGHT
KTEL

SEQ ID NO: 633 - protein, 4 aa, Artificial Sequence
  SYNTHETIC CONSTRUCT DERIVED FROM HUMAN THOUGHT
HVEL

SEQ ID NO: 634 - protein, 4 aa, Artificial Sequence
  SYNTHETIC CONSTRUCT DERIVED FROM HUMAN THOUGHT
NDEL

SEQ ID NO: 635 - protein, 4 aa, Artificial Sequence
  SYNTHETIC CONSTRUCT DERIVED FROM HUMAN THOUGHT
QDEL

SEQ ID NO: 636 - protein, 4 aa, Artificial Sequence
  SYNTHETIC CONSTRUCT DERIVED FROM HUMAN THOUGHT
REDL

SEQ ID NO: 637 - protein, 4 aa, Artificial Sequence
  SYNTHETIC CONSTRUCT DERIVED FROM HUMAN THOUGHT
RNEL

SEQ ID NO: 638 - protein, 4 aa, Artificial Sequence
  SYNTHETIC CONSTRUCT DERIVED FROM HUMAN THOUGHT
RTDL

SEQ ID NO: 639 - protein, 4 aa, Artificial Sequence
  SYNTHETIC CONSTRUCT DERIVED FROM HUMAN THOUGHT
RTEL

SEQ ID NO: 640 - protein, 4 aa, Artificial Sequence
  SYNTHETIC CONSTRUCT DERIVED FROM HUMAN THOUGHT
SDEL

SEQ ID NO: 641 - protein, 4 aa, Artificial Sequence
  SYNTHETIC CONSTRUCT DERIVED FROM HUMAN THOUGHT
TDEL

SEQ ID NO: 642 - protein, 4 aa, Artificial Sequence
  SYNTHETIC CONSTRUCT DERIVED FROM HUMAN THOUGHT
SKEL

SEQ ID NO: 643 - DNA, 52 bp, Artificial Sequence
  SYNTHETIC CONSTRUCT DERIVED FROM HUMAN THOUGHT
agctatgaggtacatgattttaggcttgctcgcccttgcggcagctgcaggc

SEQ ID NO: 644 - protein, 17 aa, Human adenovirus type 2
RYMILGLLALAAVCSAA

SEQ ID NO: 645 - protein, 18 aa, Human adenovirus type 2
MLLPVPLLLGLLGLAAAL

SEQ ID NO: 646 - protein, 15 aa, Bovine herpesvirus 1
DDELGLIMAAPARLV

SEQ ID NO: 647 - protein, 15 aa, Artificial Sequence
  SYNTHETIC CONSTRUCT DERIVED FROM HUMAN THOUGHT
DDELGLPMAAPARLV

SEQ ID NO: 648 - protein, 15 aa, Artificial Sequence
  SYNTHETIC CONSTRUCT DERIVED FROM HUMAN THOUGHT
DDELGLGMAAPARLV

SEQ ID NO: 649 - protein, 15 aa, Artificial Sequence
  SYNTHETIC CONSTRUCT DERIVED FROM HUMAN THOUGHT
DDELGLDMAAPARLV

SEQ ID NO: 650 - protein, 15 aa, mus
QGLVVHLSNPIMRNN

SEQ ID NO: 651 - protein, 15 aa, Artificial Sequence
  SYNTHETIC CONSTRUCT DERIVED FROM HUMAN THOUGHT
QGLVDHLSNPIMRNN

SEQ ID NO: 652 - protein, 15 aa, Artificial Sequence
  SYNTHETIC CONSTRUCT DERIVED FROM HUMAN THOUGHT
QGLVVHLSNPDMRNN

SEQ ID NO: 653 - protein, 15 aa, Artificial Sequence
  SYNTHETIC CONSTRUCT DERIVED FROM HUMAN THOUGHT
QGLVVHDSNPIMRNN

SEQ ID NO: 654 - protein, 42 aa, porcine circovirus 2 (virus)
MWLGSASSILLAGHVAAEVLPRCCRCRSALVILTAHFFRFQL

SEQ ID NO: 655 - protein, 314 aa, Artificial Sequence
  SYNTHETIC CONSTRUCT DERIVED FROM HUMAN THOUGHT
MPSKKNGRSGPQPHKRWVFTLNNPSEDERKKIRELPISLFDYFIVGEEGNEEGRTPHLQGFANFVKKQTFNKVKWYLGARCYIEKAKGTDQQNKEYCSKEGNLLIECGAPRSQGQRSDLSTAVSTLLESGSLVTVAEQHPVTFVRNFRGLAELLKVSGKMQKRDWKTNVHVIVGPPGCGKSKWAANFADPETTYWKPPRNKWWDGYHGEEVVVIDDFYGWLPWDDLLRLCDRYPLTVETKGGTVPFLARSILITSNQTPLEWYSSTAVPAVEALYRRITSLVFWKNATEQSTEEGGQFVTLSPPCPEFPYEINY

SEQ ID NO: 656 - protein, 314 aa, Artificial Sequence
  SYNTHETIC CONSTRUCT DERIVED FROM HUMAN THOUGHT
MPSKKNGRSGPQPHKRWVFTLNNPSEDERKKIRELPISLFDYFIVGEEGNEEGRTPHLQGFANFTKKQTFNKVKWYLGARCYIEKAKGTDQQNKEYCSKEGNLLIECGAPRSQGQRSDLSTAVSTLLESGSLVTVAEQHPVTFVRNFRGLAELLKVSGKMQKRDWKTNVHVIVGPPGCGKSKWAANFADPETTYWKPPRNKWWDGYHGEEVVVIDDFYGWLPWDDLLRLCDRYPLTVETKGGTVPFLARSILITSNQTPLEWYSSTAVPAVEALYRRITSLVFWKDATEQSTEEGGQFVTLSPPCPEFPYEINY

SEQ ID NO: 657 - protein, 314 aa, Artificial Sequence
  SYNTHETIC CONSTRUCT DERIVED FROM HUMAN THOUGHT
MPSKKNGRSGPQPHKRWVFTLNNPSEDERKKIRELPISLFDYFIVGEEGNEEGRTPHLQGFANFTKKQTFNKVKWYLGARCYIEKAKGTDQQNKEYCSKEGNLLIECGAPRSQGQRSDLSTAVSTLLESGSLVTVAEQHPVTFVRNFRGLAELLKVSGKMQKRDWKTNVHVIVGPPGCGKSKWAANFADPETTYWKPPRNKWWDGYHGEEVVVIDDFYGWLPWDDLLRLCDRYPLTVETKGGTVPFLARSILITSDQTPLEWYSSTAVPAVEALYRRITSLVFWKDATEQSTEEGGQFVTLSPPCPEFPYEINY

SEQ ID NO: 658 - protein, 104 aa, porcine circovirus 2 (virus)
MVTIPPLVSRWFPVCGFRVCKISSPFAFTTPRWPHNDVYIGLPITLLHFPAHFQKFSQPAEISDKRYRVLLCNGHQTPALQQGTHSSRQVTPLSLRSRSSTFNK

SEQ ID NO: 659 - protein, 59 aa, porcine circovirus 2 (virus)
MTCTLVFQSRFCIFPLTFKSSASPRKFLTNVTGCCSATVTRLPLSNKVLTAVDRSLRCP

SEQ ID NO: 660 - protein, 60 aa, Artificial Sequence
  SYNTHETIC CONSTRUCT DERIVED FROM HUMAN THOUGHT
MTCTLVFQSRFCIFPLTFKSSASPRKFLTDVTGCCSATVTRLPLSNKVLTAVDRSLRCPS

SEQ ID NO: 661 - protein, 21 aa, porcine circovirus 2 (virus)
MDIDHTVSVDHPTAASHKSHQ

SEQ ID NO: 662 - protein, 14 aa, porcine circovirus 2 (virus)
MKNKNHYEVIKKTQ

SEQ ID NO: 663 - protein, 53 aa, porcine circovirus 2 (virus)
MVFIFHLGFKWGVFKIKFSELYIHGYTDIVVLVVYTVFERSAEAYVVHISRGL

SEQ ID NO: 664 - protein, 29 aa, porcine circovirus 2 (virus)
MASSTPASPAPSDILSRLPQSERPPGRWT

SEQ ID NO: 665 - protein, 19 aa, porcine circovirus 2 (virus)
MAAGAVSSSAVTPPWIRHS

SEQ ID NO: 666 - protein, 234 aa, Artificial Sequence
  SYNTHETIC CONSTRUCT DERIVED FROM HUMAN THOUGHT
MTYPRRRYRRRRHRPRSHLGQILRRRPWLVHPRHRYRWRRKNGIFNTRLSRTFGYTVKATTVRTPSWAVDMMRFNIDDFVPPGGGTNKISIPFEYYRIRKVKVEFWPCSPITQGDRGVGSTAVILDDNFVTKATALTYDPYVDYSSRHTIPQPFSYHSRYFTPKPVLDSTIDYFQPNNKRTQLWLRLQTSRNVDHVGLGTAFENSIYDQDYNIRVTMYVQFREFNLKDPPLKPK

SEQ ID NO: 667 - protein, 235 aa, Artificial Sequence
  SYNTHETIC CONSTRUCT DERIVED FROM HUMAN THOUGHT
  MISC_FEATURE (8)..(8): X8 is Y or F
  MISC_FEATURE (21)..(21): X21 is Q, L, or H
  MISC_FEATURE (47)..(47): X47 is T, A, or S
  MISC_FEATURE (52)..(52): X52 is T or S
  MISC_FEATURE (53)..(53): X53 is F or I
  MISC_FEATURE (54)..(54): X54 is G or V
  MISC_FEATURE (57)..(57): X57 is V or I
  MISC_FEATURE (58)..(58): X58 is K or N
  MISC_FEATURE (59)..(59): X59 is A or R
  MISC_FEATURE (60)..(60): X60 is T or S
  MISC_FEATURE (61)..(61): X61 is T or Q
  MISC_FEATURE (63)..(63): X63 is R, S, or T
  MISC_FEATURE (75)..(75): X75 is D, N, or K
  MISC_FEATURE (76)..(76): X76 is I or F
  MISC_FEATURE (77)..(77): X77 is D or N
  MISC_FEATURE (78)..(78): X78 is D or Q
  MISC_FEATURE (86)..(86): X86 is T or S
  MISC_FEATURE (88)..(88): X88 is K or P
  MISC_FEATURE (89)..(89): X89 is I, R, or L
  MISC_FEATURE (90)..(90): X90 is S or T
  MISC_FEATURE (106)..(106): X106 is W or R
  MISC_FEATURE (107)..(107): X107 is P or A
  MISC_FEATURE (108)..(108): X108 is C or R
  MISC_FEATURE (126)..(126): X126 is T or S
  MISC_FEATURE (143)..(143): X143 is D or N
  misc_feature (189)..(189): Xaa can be any naturally occurring amino acid
  MISC_FEATURE (190)..(190): X190 is S, A, or T
  MISC_FEATURE (191)..(191): X191 is R, G, or K
  misc_feature (199)..(199): Xaa can be any naturally occurring amino acid
  MISC_FEATURE (200)..(200): X200 is T or H
  misc_feature (202)..(202): Xaa can be any naturally occurring amino acid
  MISC_FEATURE (203)..(203): X203 is E or Q
  misc_feature (205)..(205): Xaa can be any naturally occurring amino acid
  MISC_FEATURE (206)..(206): X206 is I, T, or K
  MISC_FEATURE (207)..(207): X207 is Y or N
  MISC_FEATURE (208)..(208): X208 is D or A
  misc_feature (209)..(209): Xaa can be any naturally occurring amino acid
  MISC_FEATURE (210)..(210): X210 is D, E, or A
  misc_feature (212)..(212): Xaa can be any naturally occurring amino acid
  MISC_FEATURE (213)..(213): X213 is I or V
  misc_feature (214)..(214): Xaa can be any naturally occurring amino acid
  MISC_FEATURE (215)..(215): X215 is I or V
  misc_feature (231)..(231): Xaa can be any naturally occurring amino acid
  MISC_FEATURE (232)..(232): X232 is K or N
  misc_feature (233)..(233): Xaa can be any naturally occurring amino acid
  MISC_FEATURE (234)..(234): X234 is P, K, or is absent
  MISC_FEATURE (235)..(235): X235 is K or is absent
MTYPRRRXRRRRHRPRSHLGXILRRRPWLVHPRHRYRWRRKNGIFNXRLSRXXXYTXXXXXVXTPSWAVDMMRFXXXXFVPPGGGXNXXXIPFEYYRIRKVKVEFXXXSPITQGDRGVGSTAVILXDNFVTKATALTYDPYVXYSSRHTIPQPFSYHSRYFTPKPVLDSTIDYFQPNNKRNLWLRLQTXXNVDHVGLGXAFXNSXXXQXYNXRXTMYVQFREFNLKDPPLXXXXX

SEQ ID NO: 668 - protein, 17 aa, Porcine reproductive and respiratory syndrome virus
RRGDAPEIGLPYKLYPV

SEQ ID NO: 669 - protein, 12 aa, Porcine reproductive and respiratory syndrome virus
QAAAEAYEPGRS

SEQ ID NO: 670 - protein, 9 aa, Artificial Sequence
  SYNTHETIC CONSTRUCT DERIVED FROM HUMAN THOUGHT
SDQISLYAQ

SEQ ID NO: 671 - protein, 4 aa, Artificial Sequence
  SYNTHETIC CONSTRUCT DERIVED FROM HUMAN THOUGHT
KYKY

SEQ ID NO: 672 - protein, 20 aa, human influenza virus
NAELLVLMENERTLDFHDSN

SEQ ID NO: 673 - protein, 36 aa, human influenza virus
QDLEKYVEDTKIDLWSYNAELLVALENQHTIDLTDS

SEQ ID NO: 674 - protein, 15 aa, human influenza virus
KGILGFVFTLTVPSE

SEQ ID NO: 675 - protein, 40 aa, human influenza virus
KTGGPIYRRRDGKWVRELILYDKEEIRRIWRQANNGEDAT

SEQ ID NO: 676 - protein, 23 aa, human influenza virus
RLIQNSLTIERMVLSAFDERRNK

SEQ ID NO: 677 - protein, 18 aa, human influenza virus
GKWVRELILYDKEEIRRI

SEQ ID NO: 678 - protein, 9 aa, human influenza virus
VSDGGPNLY

SEQ ID NO: 679 - protein, 10 aa, human influenza virus
RMVLASTTAK

SEQ ID NO: 680 - protein, 10 aa, human influenza virus
ALASCMGLIY

SEQ ID NO: 681 - protein, 9 aa, human influenza virus
MMMGMFNML

SEQ ID NO: 682 - protein, 20 aa, human influenza virus
TYVLSIIPSGPLKAEIAQRL

SEQ ID NO: 683 - protein, 9 aa, human influenza virus
SIIPSGPLK

SEQ ID NO: 684 - protein, 9 aa, human influenza virus
ASNENMETM

SEQ ID NO: 685 - protein, 10 aa, human influenza virus
SSLENFRAYV

SEQ ID NO: 686 - protein, 9 aa, human influenza virus
ASNENMDAM

SEQ ID NO: 687 - protein, 12 aa, human influenza virus
SFYRNVVWLIKK

SEQ ID NO: 688 - protein, 10 aa, human influenza virus
SSLENFRAYV

SEQ ID NO: 689 - protein, 10 aa, human influenza virus
SSAENFRAYV

SEQ ID NO: 690 - protein, 10 aa, human influenza virus
SSLENFAAYV

SEQ ID NO: 691 - protein, 9 aa, human influenza virus
LYIWGVHHP

SEQ ID NO: 692 - protein, 15 aa, Pseudorabies virus
PVLFGEPFRAVCVVR

SEQ ID NO: 693 - protein, 20 aa, Pseudorabies virus
SVRFVEGFAVCDGLCVPPEA

SEQ ID NO: 694 - protein, 385 aa, Pseudorabies virus
ADVDAVPAPTFPPPAYPYTESWQLTLTTVPSPFVGPADVYHTRPLEDPCGVVALISDPQVDRLLNEAVAHRRPTYRAHVAWYRIADGCAHLLYFIEYADCDPRQVFGRCRRRTTPMWWTPSADYMFPTEDELGLLMVAPGRFNEGQYRRLVSVDGVNILTDFMVALPEGQECPFARVDQHRTYKFGACWSDDSFKRGVDVMRFLTPFYQQPPHREVVNYWYRKNGRTLPRAHAAATPYAIDPARPSAGSPRPRPRPRPRPRPKPEPAPATPAPPDRLPEPATRDHAAGGRPTPRPPRPETPHRPFAPPAVVPSGWPQPAEPFQPRTPAAPGVSRHRSVIVGTGTAMGALLVGVCVYIFFRLRGAKGYRLLGGPADADELKAQPGP

SEQ ID NO: 695 - protein, 338 aa, Pseudorabies virus
ADVDAVPAPTFPPPAYPYTESWQLTLTTVPSPFVGPADVYHTRPLEDPCGVVALISDPQVDRLLNEAVAHRRPTYRAHVAWYRIADGCAHLLYFIEYADCDPRQVFGRCRRRTTPMWWTPSADYMFPTEDELGLLMVAPGRFNEGQYRRLVSVDGVNILTDFMVALPEGQECPFARVDQHRTYKFGACWSDDSFKRGVDVMRFLTPFYQQPPHREVVNYWYRKNGRTLPRAHAAATPYAIDPARPSAGSPRPRPRPRPRPRPKPEPAPATPAPPDRLPEPATRDHAAGGRPTPRPPRPETPHRPFAPPAVVPSGWPQPAEPFQPRTPAAPGVSRHRSV

SEQ ID NO: 696 - protein, 284 aa, Pseudorabies virus
ADVDAVPAPTFPPPAYPYTESWQLTLTTVPSPFVGPADVYHTRPLEDPCGVVALISDPQVDRLLNEAVAHRRPTYRAHVAWYRIADGCAHLLYFIEYADCDPRQVFGRCRRRTTPMWWTPSADYMFPTEDELGLLMVAPGRFNEGQYRRLVSVDGVNILTDFMVALPEGQECPFARVDQHRTYKFGACWSDDSFKRGVDVMRFLTPFYQQPPHREVVNYWYRKNGRTLPRAHAAATPYAIDPARPSAGSPRPRPRPRPRPRPKPEPAPATPAPPDRLPEPATRD

SEQ ID NO: 697 - protein, 278 aa, African swine fever virus
MQIFVKTLTGKTITLEVEPSDTIENVKAKIQDKEGIPPDQQRLIFAGKQLEDGRTLSDYNIQKESTLHLVLRLRGAAADFILNISMKMEVIFKTDLRSSSQVVFHAGSLYNWFSVEIINSGRIVTTAIKTLLSTVKYDIVKSARIYAGQGYTEHQAQEEWNMILHVLFEEETESSASSENIHEKNDNETNECTSSFETLFEQEPSSEVPKDSKLYMLAQKTVQHIEQYGKAPDFNKVIRAHNFIQTIYGTPLKEEEKEVVRLMVIKLLKKISFYLTYI

SEQ ID NO: 698 - protein, 386 aa, equine herpesvirus
TQKLSLGLYNQWWRVCRSVPPPWYVFFNKRSMSTFKLMMDGRLVFAMAIAILSVVLSCGTCEKAKRAVRGRQDRPKEFPPPRYNYTILTRYNATALASPFINDQVKNVDLRIVTATRPCEMIALIAKTNIDSILKELAAAQKTYSARLTWFKIMPTCATPIHDVSYMKCNPKLSFAMCDERSDILWQASLITMAAETDDELGLVLAAPAHSASGLYRRVIEIDGRRIYTDFSVTIPSERCPIAFEQNFGNPDRCKTPEQYSRGEVFTRRFLGEFNFPQGEHMTWLKFWFVYDGGNLPVQFYEAQAFARPVPPDNHPGFDSVESEITQNKTDPKPGQADPKPNQPFKWPSIKHLAPRLDEVDEVIEPVTKPPKTSKSNSTFVGISVG

SEQ ID NO: 699 - protein, 433 aa, equine herpesvirus
TQKLSLGLYNQWWRVCRSVPPPWYVFFNKRSMSTFKLMMDGRLVFAMAIAILSVVLSCGTCEKAKRAVRGRQDRPKEFPPPRYNYTILTRYNATALASPFINDQVKNVDLRIVTATRPCEMIALIAKTNIDSILKELAAAQKTYSARLTWFKIMPTCATPIHDVSYMKCNPKLSFAMCDERSDILWQASLITMAAETDDELGLVLAAPAHSASGLYRRVIEIDGRRIYTDFSVTIPSERCPIAFEQNFGNPDRCKTPEQYSRGEVFTRRFLGEFNFPQGEHMTWLKFWFVYDGGNLPVQFYEAQAFARPVPPDNHPGFDSVESEITQNKTDPKPGQADPKPNQPFKWPSIKHLAPRLDEVDEVIEPVTKPPKTSKSNSTFVGISVGLGIAGLVLVGVILYVCLRRKKELKKSAQNGLTRLRSTFKDVKYTQLP

SEQ ID NO: 700 - protein, 19 aa, equine herpesvirus
MPAVLLVLYVNPPPSVCIL

SEQ ID NO: 701 - protein, 16 aa, coronavirus
NYNYKYRYLRGKLRPF

SEQ ID NO: 702 - protein, 15 aa, coronavirus
PLQASLPFGWLVIGV

SEQ ID NO: 703 - protein, 10 aa, coronavirus
TLACFVLAAV

SEQ ID NO: 704 - protein, 10 aa, coronavirus
GYQPYRVVVL

SEQ ID NO: 705 - protein, 10 aa, coronavirus
QPYRVVVLSF

SEQ ID NO: 706 - protein, 9 aa, coronavirus
PYRVVVLSF

SEQ ID NO: 707 - protein, 15 aa, coronavirus
KPSFYVYSRVKNLNS

SEQ ID NO: 708 - protein, 15 aa, coronavirus
NIVNVSLVKPSFYVY

SEQ ID NO: 709 - protein, 9 aa, coronavirus
VSDGGPNLY

SEQ ID NO: 710 - protein, 15 aa, coronavirus
VIGAVILRGHLRIAG

SEQ ID NO: 711 - protein, 15 aa, coronavirus
FNATRFASVYAWNRK

SEQ ID NO: 712 - protein, 15 aa, coronavirus
ADSFVIRGDEVRQIA

SEQ ID NO: 713 - protein, 15 aa, coronavirus
ISNCVADYSVLYNSA

SEQ ID NO: 714 - protein, 15 aa, coronavirus
IWLGFIAGLIAIVMV

SEQ ID NO: 715 - protein, 15 aa, coronavirus
FLHVTYVPAQEKNFT

SEQ ID NO: 716 - protein, 98 aa, Artificial Sequence
  SYNTHETIC CONSTRUCT DERIVED FROM HUMAN THOUGHT
MHGDTPTLHEYMLDLQPETTDLYCYEQLDDSSEEEDEIDGPAGQAEPDRAHYNIVTFCCKCDSTLRLCVQSTHVDIRTLEDLLMGTLGIVCPICSQKP

SEQ ID NO: 717 - protein, 9 aa, Homo sapiens
IYNEYIYDL

SEQ ID NO: 718 - protein, 9 aa, Homo sapiens
EYYELFVNI

SEQ ID NO: 719 - protein, 19 aa, Artificial Sequence
  SYNTHETIC CONSTRUCT DERIVED FROM HUMAN THOUGHT
  MISC_FEATURE (3)..(3): X3 IS ANY AMINO ACID
  MISC_FEATURE (4)..(4): X4 IS ANY AMINO ACID
  MISC_FEATURE (6)..(6): X6 IS ANY AMINO ACID
  MISC_FEATURE (8)..(8): X8 IS ANY AMINO ACID
  MISC_FEATURE (9)..(9): X9 IS ANY AMINO ACID
  MISC_FEATURE (10)..(10): X10 IS ANY AMINO ACID
  MISC_FEATURE (11)..(11): X11 IS ANY AMINO ACID
  MISC_FEATURE (14)..(14): X14 IS ANY AMINO ACID
  MISC_FEATURE (15)..(15): X15 IS ANY AMINO ACID
MAXXNXFXXXXLPXXDRLT

SEQ ID NO: 720 - protein, 22 aa, Artificial Sequence
  SYNTHETIC CONSTRUCT DERIVED FROM HUMAN THOUGHT
  MISC_FEATURE (2)..(2): X2 IS ANY AMINO ACID
  MISC_FEATURE (3)..(3): X3 is N or G
  MISC_FEATURE (5)..(5): X5 is any amino acid or is absent
  MISC_FEATURE (6)..(6): X6 is any amino acid or is absent
  MISC_FEATURE (9)..(9): X9 is I or L
  MISC_FEATURE (10)..(10): X10 is Q or E
  MISC_FEATURE (11)..(11): X11 is any amino acid
  MISC_FEATURE (12)..(12): X12 is any amino acid
  MISC_FEATURE (13)..(13): X13 is A or T
  MISC_FEATURE (14)..(14): X14 is any amino acid
  MISC_FEATURE (16)..(16): X16 is any amino acid
  MISC_FEATURE (17)..(17): X17 is any amino acid
  MISC_FEATURE (18)..(18): X18 is any amino acid
PXXWXXPSXXXXXXPXXXPATP

SEQ ID NO: 721 - protein, 29 aa, Artificial Sequence
  SYNTHETIC CONSTRUCT DERIVED FROM HUMAN THOUGHT
  MISC_FEATURE (2)..(2): X2 is any amino acid
  MISC_FEATURE (2)..(2): X5 is any amino acid
  MISC_FEATURE (3)..(3): X3 is any amino acid
  MISC_FEATURE (4)..(4): X4 is any amino acid
  misc_feature (5)..(5): Xaa can be any naturally occurring amino acid
  MISC_FEATURE (8)..(8): X8 is any amino acid or is absent
  MISC_FEATURE (9)..(9): X9 is any amino acid
  MISC_FEATURE (10)..(10): X10 is any amino acid
  MISC_FEATURE (11)..(11): X11 is I or V
  MISC_FEATURE (13)..(13): X13 is any amino acid
  MISC_FEATURE (14)..(14): X14 is N or G
  MISC_FEATURE (16)..(16): X16 is any amino acid
  MISC_FEATURE (17)..(17): X17 is any amino acid
  MISC_FEATURE (19)..(19): X19 is S or A
  MISC_FEATURE (20)..(20): X20 is any amino acid
  MISC_FEATURE (20)..(28): X20-X28 comprise 1-4 P residues
  MISC_FEATURE (21)..(21): X21 is any amino acid
  MISC_FEATURE (22)..(22): X22 is any amino acid
  MISC_FEATURE (23)..(23): X23 is any amino acid
  MISC_FEATURE (24)..(24): X24 is any amino acid
  MISC_FEATURE (25)..(25): X25 is any amino acid
  MISC_FEATURE (26)..(26): X26 is any amino acid
  MISC_FEATURE (27)..(27): X27 is any amino acid
  MISC_FEATURE (28)..(28): X28 is any amino acid
PXXXXAPXXXXPXXWXXPXXXXXXXXXXP

SEQ ID NO: 722 - protein, 13 aa, Artificial Sequence
  SYNTHETIC CONSTRUCT DERIVED FROM HUMAN THOUGHT
QIPPNWHIPSIQD

SEQ ID NO: 723 - protein, 132 aa, Artificial Sequence
  SYNTHETIC CONSTRUCT DERIVED FROM HUMAN THOUGHT
  MISC_FEATURE (9)..(9): X9 IS ANY AMINO ACID
  MISC_FEATURE (13)..(13): X13 IS Q OR R
  MISC_FEATURE (14)..(14): X14 IS D OR E
  MISC_FEATURE (17)..(17): X17 IS T OR A
  MISC_FEATURE (22)..(22): X22 IS ANY AMINO ACID
  MISC_FEATURE (30)..(30): X30 IS L OR I
  MISC_FEATURE (36)..(36): X36 IS I OR V
  MISC_FEATURE (39)..(39): X39 IS V OR A
  MISC_FEATURE (48)..(48): X48 IS N OR K
  MISC_FEATURE (49)..(49): X49 IS I OR L
  MISC_FEATURE (52)..(52): X52 IS T OR S
  MISC_FEATURE (68)..(68): X68 IS ANY AMINO ACID
  MISC_FEATURE (69)..(69): X69 IS ANY AMINO ACID
  MISC_FEATURE (70)..(70): X70 IS ANY AMINO ACID
  MISC_FEATURE (71)..(71): X71 IS S OR T
  MISC_FEATURE (73)..(73): X73 IS K OR R
  MISC_FEATURE (74)..(74): X74 IS ANY AMINO ACID
  MISC_FEATURE (75)..(75): X75 IS V OR I
  MISC_FEATURE (78)..(78): X78 IS S OR N
  MISC_FEATURE (80)..(80): X80 IS K OR Q
  MISC_FEATURE (83)..(83): X83 IS I OR V
  MISC_FEATURE (86)..(86): X86 IS F OR Y
  MISC_FEATURE (87)..(87): X87 IS ANY AMINO ACID
  MISC_FEATURE (90)..(90): X90 IS N OR G
  MISC_FEATURE (93)..(93): X93 IS M OR L
  MISC_FEATURE (98)..(98): X98 IS ANY AMINO ACID
  MISC_FEATURE (99)..(99): X99 IS K OR N
  MISC_FEATURE (102)..(102): X102 IS ANY AMINO ACID
  MISC_FEATURE (104)..(104): X104 IS T OR N
  MISC_FEATURE (105)..(105): X105 IS S OR N
  MISC_FEATURE (106)..(106): X106 IS ANY AMINO ACID
  MISC_FEATURE (107)..(107): X107 IS ANY AMINO ACID
  MISC_FEATURE (108)..(108): X108 IS ANY AMINO ACID
  MISC_FEATURE (110)..(110): X110 IS ANY AMINO ACID
  MISC_FEATURE (113)..(113): X113 IS L OR M
  MISC_FEATURE (114)..(114): X114 IS K OR E
  MISC_FEATURE (118)..(118): X118 IS E OR N
  MISC_FEATURE (119)..(119): X119 IS T OR V
  MISC_FEATURE (120)..(120): X120 IS F OR Y
  MISC_FEATURE (121)..(121): X121 IS ANY AMINO ACID
  MISC_FEATURE (123)..(123): X123 IS S OR T
  MISC_FEATURE (124)..(124): X124 IS N OR D
  MISC_FEATURE (125)..(125): X125 IS ANY AMINO ACID
  MISC_FEATURE (126)..(126): X126 IS D OR E
MDLPYYHGXLTKXXCEXLLLKXGVDGNFLXRDSESXPGXLCLCVSFKXXVYXYRIFREKHGYYRIQTXXXXPXXXFPXLXELXSKXXKPXQGXVVHLXXPIXRXXXXXRXRGXXLELXXXXNXXXXYVDVLP

SEQ ID NO: 724 - protein, 296 aa, Porcine circovirus
VRRESPKHRWCFTINDWTPTEWESIVECGGSIARYLIIGKEVGKSGTPHLQGYVNFKNKRRLSSVKRLPGFGRAHLEPARGSHKEASEYCKKEGDYLEIGEDSSSGTRSDLQAAARILTETAGNLTEVAEKMPAVFIRYGRGLRDFCGVMGLGKPRDFKTEVYVFIGPPGCGKTREACADAAARELQLYFKPRGPWWDGYNGEGAVILDDFYGWVPFDELLRIGDRYPLRVPVKGGFVNFVAKVLYITSNVVPEEWYSSENIRGKLEALFRRFTKVVCWGEGGVKKDMETVYPINY

SEQ ID NO: 725 - protein, 296 aa, Porcine circovirus
VRRESPKHRWCFTINNWTPTEWESIVECGGSIARYLIIGKEVGKSGTPHLQGYVNFKNKRRLSSVKRLPGFGRAHLEPARGSHKEASEYCKKEGDYLEIGEDSSSGTRSDLQAAARILTETAGDLTEVAEKMPAVFIRYGRGLRDFCGVMGLGKPRDFKTEVYVFIGPPGCGKTREACADAAARELQLYFKPRGPWWDGYNGEGAVILDDFYGWVPFDELLRIGDRYPLRVPVKGGFVNFVAKVLYITSNVVPEEWYSSENIRGKLEALFRRFTKVVCWGEGGVKKDMETVYPINY

SEQ ID NO: 726 - protein, 296 aa, Porcine circovirus
VRRESPKHRWCFTINDWTPTEWESIVECGGSIARYLIIGKEVGKSGTPHLQGYVNFKNKRRLSSVKRLPGFGRAHLEPARGSHKEASEYCKKEGDYLEIGEDSSSGTRSDLQAAARILTETAGDLTEVAEKMPAVFIRYGRGLRDFCGVMGLGKPRDFKTEVYVFIGPPGCGKTREACADAAARELQLYFKPRGPWWDGYNGEGAVILDDFYGWVPFDELLRIGDRYPLRVPVKGGFVNFVAKVLYITSNVVPEEWYSSENIRGKLEALFRRFTKVVCWGEGGVKKDMETVYPINY

SEQ ID NO: 727 - protein, 296 aa, Porcine circovirus
VRRESPKHRWCFTINNWTPTEWESIVECGGSIARYLIIGKEVGKSGTPHLQGYVNFKNKRRLSSVKRLPGFGRAHLEPARGSHKEASEYCKKEGDYLEIGEDSSSGTRSDLQAAARILTETAGNLTEVAEKMPAVFIRYGRGLRDFCGVMGLGKPRDFKTEVYVFIGPPGCGKTREACADAAARELQLYFKPRGPWWDGYNGEGAVILDDFYGWVPFDELLRIGDRYPLRVPVKGGFVNFVAKVLYITSNVVPEEWYSSENIRGKLEALFRRFTKVVCWGEGGVKKDMETVYPINY

SEQ ID NO: 728 - protein, 214 aa, Porcine circovirus
MRHRAIFRRRPRPRRRRRHRRRYVRRKLFIRRPTAGTYYTKKYSTMNVISVGTPQNNKPWHANHFITRLNEWETAISFEYYKILKMKVTLSPVISPAQQTKTMFGHTAIDLDGAWTTNTWLQDDPYAESSTRKVMTSKKKHSRYFTPKPILAGTTSAHPGQSLFFFSRPTPWLNTYDPTVQWGALLWSIYVPEKTGMTDFYGTKEVWIRYKSVL

SEQ ID NO: 729 - protein, 10 aa, Human immunodeficiency virus
RKKRRQRRRR

SEQ ID NO: 730 - protein, 5 aa, Artificial Sequence
  SYNTHETIC CONSTRUCT DERIVED FROM HUMAN THOUGHT
GPGPG

SEQ ID NO: 731 - protein, 5 aa, Artificial Sequence
  SYNTHETIC CONSTRUCT DERIVED FROM HUMAN THOUGHT
YVPGP

SEQ ID NO: 732 - protein, 5 aa, Homo sapiens
YVPGP

SEQ ID NO: 733 - protein, 7 aa, human influenza virus
KRRSNKS

SEQ ID NO: 734 - protein, 15 aa, African swine fever virus
SFLNLTKLYHHHSHY

SEQ ID NO: 735 - protein, 15 aa, African swine fever virus
KYNLNRKKSHYTDLL

SEQ ID NO: 736 - protein, 15 aa, African swine fever virus
NRKKSHYTDLLFICS

SEQ ID NO: 737 - protein, 15 aa, African swine fever virus
SPPPKPCPPPKPCPP

SEQ ID NO: 738 - protein, 15 aa, African swine fever virus
KPCPPPKPCPPPKPC

SEQ ID NO: 739 - protein, 18 aa, African swine fever virus
PEERCTYKFNSYTKKMEL

SEQ ID NO: 740 - protein, 19 aa, African swine fever virus
DQEEKKALQNKETKNLGIP

SEQ ID NO: 741 - protein, 9 aa, Homo sapiens
KQMNDARHG

SEQ ID NO: 742 - protein, 9 aa, Homo sapiens
LSKITEQEK

SEQ ID NO: 743 - protein, 9 aa, Homo sapiens
STRDPLSKI

SEQ ID NO: 744 - protein, 138 aa, Artificial Sequence
  Synthetic construct derived from human thought
  MISC_FEATURE (1)..(1): X1 is V, T, or N
  MISC_FEATURE (2)..(2): X2 is any amino acid
  MISC_FEATURE (3)..(3): X3 is Y or H
  MISC_FEATURE (4)..(4): X4 is A, T, V, or L
  MISC_FEATURE (5)..(5): X5 is V, T, R, or I
  MISC_FEATURE (6)..(6): X6 is any amino acid
  MISC_FEATURE (7)..(7): X7 is any amino acid
  MISC_FEATURE (8)..(8): X8 is any amino acid or is absent
  MISC_FEATURE (9)..(9): X9 is R, A, D, or E
  MISC_FEATURE (10)..(10): X10 is any amino acid
  MISC_FEATURE (12)..(12): X12 is R, D, G, or S
  MISC_FEATURE (13)..(13): X13 is S, M, V, F
  MISC_FEATURE (14)..(14): X14 is V, L, or A
  MISC_FEATURE (15)..(15): X15 is any amino acid
  MISC_FEATURE (17)..(17): X17 is N, I, or W
  MISC_FEATURE (18)..(18): X18 is A, S, or P
  MISC_FEATURE (19)..(19): X19 is any amino acid
  MISC_FEATURE (20)..(20): X20 is S, P, T, or G
  MISC_FEATURE (21)..(21): X21 is E, Q, D, or N
  MISC_FEATURE (22)..(22): X22 is A, V, P, or I
  MISC_FEATURE (23)..(23): X23 is any amino acid
  MISC_FEATURE (24)..(24): X24 is any amino acid
  MISC_FEATURE (25)..(25): X25 is I, T, L, V, or M
  MISC_FEATURE (26)..(26): X26 is V, L, or I
  MISC_FEATURE (27)..(27): X27 is any amino acid
  MISC_FEATURE (28)..(28): X28 is any amino acid
  MISC_FEATURE (29)..(29): X29 is A, L, Q, or I
  MISC_FEATURE (30)..(30): X30 is any amino acid or is absent
  MISC_FEATURE (31)..(31): X31 is any amino acid or is absent
  MISC_FEATURE (32)..(32): X32 is any amino acid or is absent
  MISC_FEATURE (33)..(33): X33 is any amino acid or is absent
  MISC_FEATURE (34)..(34): X34 is any amino acid or is absent
  MISC_FEATURE (35)..(35): X35 is any amino acid or is absent
  MISC_FEATURE (36)..(36): X36 is P, V, S, L, or Q
  MISC_FEATURE (37)..(37): X37 is any amino acid or is absent
  MISC_FEATURE (38)..(38): X38 is any amino acid or is absent
  MISC_FEATURE (39)..(39): X39 is any amino acid or is absent
  MISC_FEATURE (40)..(40): X40 is any amino acid or is absent
  MISC_FEATURE (41)..(41): X41is any amino acid or is absent
  MISC_FEATURE (42)..(42): X42 is any amino acid or is absent
  MISC_FEATURE (43)..(43): X43 is any amino acid or is absent
  MISC_FEATURE (44)..(44): X44 is Y or F
  MISC_FEATURE (45)..(45): X45 is N, R, D, or E
  MISC_FEATURE (46)..(46): X46 is L or A
  MISC_FEATURE (47)..(47): X47 is T, H, L, or S
  MISC_FEATURE (48)..(48): X48 is I, V, or L
  MISC_FEATURE (49)..(49): X49 is A, I, S or V
  MISC_FEATURE (51)..(51): X51 is F or Y
  MISC_FEATURE (52)..(52): X52 is R, K, or V
  MISC_FEATURE (52)..(52): X53 is any amino acid
  misc_feature (53)..(53): Xaa can be any naturally occurring amino acid
  MISC_FEATURE (54)..(54): X54 is any amino acid
  MISC_FEATURE (55)..(55): X55 is any amino acid
  MISC_FEATURE (56)..(56): X56 is N, G, D, A, or M
  MISC_FEATURE (57)..(57): X57 is any amino acid or is absent
  MISC_FEATURE (58)..(58): X58 is any amino acid or is absent
  MISC_FEATURE (59)..(59): X59 is any amino acid or is absent
  MISC_FEATURE (60)..(60): X60 is any amino acid or is absent
  MISC_FEATURE (61)..(61): X61 is any amino acid or is absent
  MISC_FEATURE (62)..(62): X62 is any amino acid or is absent
  MISC_FEATURE (64)..(64): X64 is A, G, E, or T or is absent
  MISC_FEATURE (65)..(65): X65 is I, R, H, Y, or is absent
  MISC_FEATURE (66)..(66): X66 is P or L
  MISC_FEATURE (67)..(67): X67 is I, L, or M
  MISC_FEATURE (68)..(68): X68 is T, Y, L, or F
  MISC_FEATURE (69)..(69): X69 is any amino acid
  MISC_FEATURE (70)..(70): X70 is M, I, R, or K
  MISC_FEATURE (71)..(71): X71 is E, D, or Q
  MISC_FEATURE (72)..(72): X72 is Y, F, or M
  MISC_FEATURE (73)..(73): X73 is any amino acid
  MISC_FEATURE (74)..(74): X74 is E, D, N, or L
  MISC_FEATURE (76)..(76): X76 is any amino acid
  MISC_FEATURE (77)..(77): X77 is Y, P, T, or D
  MISC_FEATURE (78)..(78): X78 is N, R, D, K, Q, or V
  MISC_FEATURE (79)..(79): X79 is K, Q, E, or R
  MISC_FEATURE (80)..(80): X80 is any amino acid
  MISC_FEATURE (81)..(81): X81 is L or F
  MISC_FEATURE (82)..(82): X82 is G or S
  MISC_FEATURE (83)..(83): X83 is any amino acid
  MISC_FEATURE (85)..(85): X85 is any amino acid
  MISC_FEATURE (86)..(86): X86 is any amino acid
  MISC_FEATURE (87)..(87): X87 is R, K, S, or Q
  MISC_FEATURE (88)..(88): X88 is T, N, or S
  MISC_FEATURE (89)..(89): X89 is any amino acid
  MISC_FEATURE (90)..(90): X90 is P, G, S, D, or Q
  MISC_FEATURE (91)..(91): X91 is R, F, M, W, or Y
  MISC_FEATURE (93)..(93): X93 is any amino acid
  MISC_FEATURE (94)..(94): X94 is any amino acid or is absent
  MISC_FEATURE (95)..(95): X95 is any amino acid
  MISC_FEATURE (96)..(96): X96 is Y, L, or S
  MISC_FEATURE (97)..(97): X97 is D, A, V, or T
  MISC_FEATURE (98)..(98): X98 is any residue
  MISC_FEATURE (99)..(99): X99 is F, Y, T, or S
  MISC_FEATURE (100)..(100): X100 is S, A, M, or T
  MISC_FEATURE (101)..(101): X101 is A, Y, F, or L
  MISC_FEATURE (102)..(102): X102 is any residue
  MISC_FEATURE (103)..(103): X103 is S, T, or G
  MISC_FEATURE (104)..(104): X104 is E, D, or R
  MISC_FEATURE (105)..(105): X105 is D or N
  MISC_FEATURE (106)..(106): X106 is N, E, or G
  MISC_FEATURE (107)..(107): X107 is L or A
  MISC_FEATURE (109)..(109): X109 is F or L
  MISC_FEATURE (110)..(110): X110 is L, I, V, or T
  MISC_FEATURE (111)..(111): X111 is M, I, F, or L
  MISC_FEATURE (112)..(112): X112 is H, A, V, M, or F
  MISC_FEATURE (113)..(113): X113 is A or S
  MISC_FEATURE (115)..(115): X115 is F, R, Q, P, or A
  MISC_FEATURE (116)..(116): X116 is E, L, F, or A
  MISC_FEATURE (117)..(117): X117 is T, V, N, or L
  MISC_FEATURE (118)..(118): X118 is any amino acid
  MISC_FEATURE (120)..(120): X120 is T, Q, or L
  MISC_FEATURE (122)..(122): X122 is L, R, or T
  MISC_FEATURE (123)..(123): X123 is R or L
  MISC_FEATURE (124)..(124): X124 is L, A, V, or T
  MISC_FEATURE (125)..(125): X125 is V, L, or I
  MISC_FEATURE (126)..(126): X126 is any amino acid
  MISC_FEATURE (127)..(127): X127 is I or V
  MISC_FEATURE (128)..(128): X128 is N, D, E, or G
  MISC_FEATURE (129)..(129): X129 is D, G, N, or R
  MISC_FEATURE (130)..(130): X130 is W, T, V, E, D, S, or F
  MISC_FEATURE (131)..(131): X131 is any amino acid
  MISC_FEATURE (132)..(132): X132 is any amino acid
  MISC_FEATURE (133)..(133): X133 is any amino acid
  MISC_FEATURE (134)..(134): X134 is T, S, or A
  MISC_FEATURE (135)..(135): X135 is Q, D, or L
  MISC_FEATURE (136)..(136): X136 is F, I, or V
  MISC_FEATURE (137)..(137): X137 is I, M, L, or T
  MISC_FEATURE (138)..(138): X138 is L, V, or F
XXXXXXXXXXCXXXXLXXXXXXXXXXXXXXXXXXXXXXXXXXXXXXXXXWXXXXXXXXXXXXCXXXXXXXXXXXCXXXXXXXXCXXXXXXXWXXXXXXXXXXXXXXXGXXXXXPXXXXGXYXXXXXXXXXXXXXXXXX

SEQ ID NO: 745 - protein, 138 aa, Artificial Sequence; identical to SEQ ID NO: 744
  Synthetic construct derived from human thought
  MISC_FEATURE (1)..(1): X1 is V, T, or N
  MISC_FEATURE (2)..(2): X2 is Y, R, or K
  MISC_FEATURE (3)..(3): X3 is Y or H
  MISC_FEATURE (4)..(4): X4 is A, T, V, or L
  MISC_FEATURE (5)..(5): X5 is V, T, R, or I
  MISC_FEATURE (6)..(6): X6 is L, S, P, Y, or R
  MISC_FEATURE (7)..(7): X7 is E, A, L, T, D, M, or V
  MISC_FEATURE (8)..(8): X8 is any amino acid or is absent
  MISC_FEATURE (9)..(9): X9 is R, A, D, or E
  MISC_FEATURE (10)..(10): X10 is A, P, N, S, or G
  MISC_FEATURE (12)..(12): X12 is R, D, G, or S
  MISC_FEATURE (13)..(13): X13 is S, M, V, or F
  MISC_FEATURE (14)..(14): X14 is V, L, or A
  MISC_FEATURE (15)..(15): X15 is L, A, V, or E
  MISC_FEATURE (17)..(17): X17 is N, I, or W
  MISC_FEATURE (18)..(18): X18 is A, S, or P
  MISC_FEATURE (19)..(19): X19 is P, D, F, I, E, or N
  MISC_FEATURE (20)..(20): X20 is S, P, T, or G
  MISC_FEATURE (21)..(21): X21 is E, Q, D, or N
  MISC_FEATURE (22)..(22): X22 is A, V, P, or I
  MISC_FEATURE (23)..(23): X23 is P, G, D, V, K, or E
  MISC_FEATURE (24)..(24): X24 is Q, R, Y, A, S, or D
  MISC_FEATURE (25)..(25): X25 is I, T, L, V, or M
  MISC_FEATURE (26)..(26): X26 is V, L, or I
  MISC_FEATURE (27)..(27): X27 is R, W, N, L, or S
  MISC_FEATURE (28)..(28): X28 is G, E, S, T, or A
  MISC_FEATURE (29)..(29): X29 is A, L, Q, or I
  MISC_FEATURE (30)..(30): X30 is any amino acid or is absent
  MISC_FEATURE (31)..(31): X31 is any amino acid or is absent
  MISC_FEATURE (32)..(32): X32 is any amino acid or is absent
  MISC_FEATURE (33)..(33): X33 is any amino acid or is absent
  MISC_FEATURE (34)..(34): X34 is any amino acid or is absent
  MISC_FEATURE (35)..(35): X35 is any amino acid or is absent
  MISC_FEATURE (36)..(36): X36 is P, V, S, L, or Q
  MISC_FEATURE (37)..(37): X37 is any amino acid or is absent
  MISC_FEATURE (38)..(38): X38 is any amino acid or is absent
  MISC_FEATURE (39)..(39): X39 is any amino acid or is absent
  MISC_FEATURE (40)..(40): X40 is any amino acid or is absent
  MISC_FEATURE (41)..(41): X41 is any amino acid or is absent
  MISC_FEATURE (42)..(42): X42 is any amino acid or is absent
  MISC_FEATURE (43)..(43): X43 is any amino acid or is absent
  MISC_FEATURE (44)..(44): X44 is Y or F
  MISC_FEATURE (45)..(45): X45 is N, R, D, or E
  MISC_FEATURE (46)..(46): X46 is L or A
  MISC_FEATURE (47)..(47): X47 is T, H, L, or S
  MISC_FEATURE (48)..(48): X48 is I, V, or L
  MISC_FEATURE (49)..(49): X49 is A, I, S, or V
  MISC_FEATURE (51)..(51): X51 is F or Y
  MISC_FEATURE (52)..(52): X52 is R, K, or V
  MISC_FEATURE (53)..(53): X53 is M, I, T, L, or V
  MISC_FEATURE (54)..(54): X54 is G, E, A, S, T, or I
  MISC_FEATURE (55)..(55): X55 is G, S, D, R, K, Q, or D
  MISC_FEATURE (56)..(56): X56 is N, G, D, A, or M
  MISC_FEATURE (57)..(57): X57 is any amino acid or is absent
  MISC_FEATURE (58)..(58): X58 is any amino acid or is absent
  MISC_FEATURE (59)..(59): X59 is any amino acid or is absent
  MISC_FEATURE (60)..(60): X60 is any amino acid or is absent
  MISC_FEATURE (61)..(61): X61 is any amino acid or is absent
  MISC_FEATURE (62)..(62): X62 is any amino acid or is absent
  MISC_FEATURE (64)..(64): X64 is A, G, E, or T, or is absent
  MISC_FEATURE (65)..(65): X65 is I, R, H, Y, or is absent
  MISC_FEATURE (66)..(66): X66 is P or L
  MISC_FEATURE (67)..(67): X67 is I, L, or M
  MISC_FEATURE (68)..(68): X68 is T, Y, L, or F
  MISC_FEATURE (69)..(69): X69 is V, Y, F, L, or R
  MISC_FEATURE (70)..(70): X70 is M, I, R, or K
  MISC_FEATURE (71)..(71): X71 is E, D, or Q
  MISC_FEATURE (72)..(72): X72 is Y, F, or M
  MISC_FEATURE (73)..(73): X73 is T, A, Y, R, or F
  MISC_FEATURE (74)..(74): X74 is E, D, N, or L
  MISC_FEATURE (76)..(76): X76 is S, E, D, Q, or G
  MISC_FEATURE (77)..(77): X77 is Y, P, T, or D
  MISC_FEATURE (78)..(78): X78 is N, R, D, K, Q, or V
  MISC_FEATURE (79)..(79): X79 is K, Q, E, or R
  MISC_FEATURE (80)..(80): X80 is S, H, V, P, E, or L
  MISC_FEATURE (81)..(81): X81 is L or F
  MISC_FEATURE (82)..(82): X82 is G or S
  MISC_FEATURE (83)..(83): X83 is A, Y, R, T, or E
  MISC_FEATURE (85)..(85): X85 is P, R, K, S, A, or L
  MISC_FEATURE (86)..(86): X86 is I, Y, R, V, L, M, or K
  MISC_FEATURE (87)..(87): X87 is R, K, S, or Q
  MISC_FEATURE (88)..(88): X88 is T, N, or S
  MISC_FEATURE (89)..(89): X89 is Q, P, T, L, or A
  MISC_FEATURE (90)..(90): X90 is P, G, S, D, or Q
  MISC_FEATURE (91)..(91): X91 is R, F, M, W, or Y
  MISC_FEATURE (93)..(93): X93 is N, D, W, S, L, K, or A
  MISC_FEATURE (94)..(94): X94 is S, T, R, E, P, or V, or is absent
  MISC_FEATURE (95)..(95): X95 is Y, F, P, R, S, or D
  MISC_FEATURE (96)..(96): X96 is Y, L, or S
  MISC_FEATURE (97)..(97): X97 is D, A, V, or T
  MISC_FEATURE (98)..(98): X98 is S, G, M, K, or P
  MISC_FEATURE (99)..(99): X99 is F, Y, T, or S
  MISC_FEATURE (100)..(100): X100 is S, A, M, or T
  MISC_FEATURE (101)..(101): X101 is A, Y, F, or L
  MISC_FEATURE (102)..(102): X102 is V, P, T, I, or L
  MISC_FEATURE (103)..(103): X103 is S, T, or G
  MISC_FEATURE (104)..(104): X104 is E, D, or R
  MISC_FEATURE (105)..(105): X105 is D or N
  MISC_FEATURE (106)..(106): X106 is N, E, or G
  MISC_FEATURE (107)..(107): X107 is L or A
  MISC_FEATURE (109)..(109): X109 is F or L
  MISC_FEATURE (110)..(110): X110 is L, I, V, or T
  MISC_FEATURE (111)..(111): X111 is M, I, F, or L
  MISC_FEATURE (112)..(112): X112 is H, A, V, M, or F
  MISC_FEATURE (113)..(113): X113 is A or S
  MISC_FEATURE (115)..(115): X115 is F, R, Q, P, or A
  MISC_FEATURE (116)..(116): X116 is E, L, F, or A
  MISC_FEATURE (117)..(117): X117 is T, V, N, or L
  MISC_FEATURE (118)..(118): X118 is A, E, S, D, or Q
  MISC_FEATURE (120)..(120): X120 is T, Q, or L
  MISC_FEATURE (122)..(122): X122 is L, R, or T
  MISC_FEATURE (123)..(123): X123 is R or L
  MISC_FEATURE (124)..(124): X124 is L, A, V, or T
  MISC_FEATURE (125)..(125): X125 is V, L, or I
  MISC_FEATURE (126)..(126): X126 is K, Y, S, I, V, T, or Q
  MISC_FEATURE (127)..(127): X127 is I or V
  MISC_FEATURE (128)..(128): X128 is N, D, E, or G
  MISC_FEATURE (129)..(129): X129 is D, G, N, or R
  MISC_FEATURE (130)..(130): X130 is W, T, V, E, D, S, or F
  MISC_FEATURE (131)..(131): X131 is T, V, N, P, F, M, or A
  MISC_FEATURE (132)..(132): X132 is E, A, I, T, F, or Q
  MISC_FEATURE (133)..(133): X133 is I, Y, L, V, S, or T
  MISC_FEATURE (134)..(134): X134 is T, S, or A
  MISC_FEATURE (135)..(135): X135 is Q, D, or L
  MISC_FEATURE (136)..(136): X136 is F, I, or V
  MISC_FEATURE (137)..(137): X137 is I, M, L, or T
  MISC_FEATURE (138)..(138): X138 is L, V, or F

SEQ ID NO: 746 - protein, 138 aa, Artificial Sequence
  Synthetic sequence derived from human thought.
  MISC_FEATURE (2)..(2): X2 is Y, R, or K
  MISC_FEATURE (3)..(3): X3 is Y or H
  MISC_FEATURE (4)..(4): X4 is A, T, V, or L
  MISC_FEATURE (5)..(5): X5 is V, T, R, or I
  MISC_FEATURE (6)..(6): X6 is L, S, P, Y, or R
  MISC_FEATURE (7)..(7): X7 is E, A, L, T, D, M, or V
  MISC_FEATURE (8)..(8): X8 is any amino acid or is absent
  MISC_FEATURE (9)..(9): X9 is R, A, D, or E
  MISC_FEATURE (10)..(10): X10 is A, P, N, S, or G
  MISC_FEATURE (12)..(12): X12 is R, D, G, or S
  MISC_FEATURE (13)..(13): X13 is S, M, V, or F
  MISC_FEATURE (14)..(14): X14 is V, L, or A
  MISC_FEATURE (15)..(15): X15 is L, A, V, or E
  MISC_FEATURE (17)..(17): X17 is N, I, or W
  MISC_FEATURE (18)..(18): X18 is A, S, or P
  MISC_FEATURE (19)..(19): X19 is P, D, F, I, E, or N
  MISC_FEATURE (20)..(20): X20 is S, P, T, or G
  MISC_FEATURE (21)..(21): X21 is E, Q, D, or N
  MISC_FEATURE (22)..(22): X22 is A, V, P, or I
  MISC_FEATURE (23)..(23): X23 is P, G, D, V, K, or E
  MISC_FEATURE (24)..(24): X24 is Q, R, Y, A, S, or D
  MISC_FEATURE (25)..(25): X25 is I, T, L, V, or M
  MISC_FEATURE (26)..(26): X26 is V, L, or I
  MISC_FEATURE (27)..(27): X27 is R, W, N, L, or S
  MISC_FEATURE (28)..(28): X28 is G, E, S, T, or A
  MISC_FEATURE (29)..(29): X29 is A, L, Q, or I
  MISC_FEATURE (30)..(30): X30 is any amino acid or is absent
  MISC_FEATURE (31)..(31): X31 is any amino acid or is absent
  MISC_FEATURE (32)..(32): X32 is any amino acid or is absent
  MISC_FEATURE (33)..(33): X33 is any amino acid or is absent
  MISC_FEATURE (34)..(34): X34 is any amino acid or is absent
  MISC_FEATURE (35)..(35): X35 is any amino acid or is absent
  MISC_FEATURE (36)..(36): X36 is P, V, S, L, or Q
  MISC_FEATURE (37)..(37): X37 is any amino acid or is absent
  MISC_FEATURE (38)..(38): X38 is any amino acid or is absent
  MISC_FEATURE (39)..(39): X39 is any amino acid or is absent
  MISC_FEATURE (40)..(40): X40 is any amino acid or is absent
  MISC_FEATURE (41)..(41): X41 is any amino acid or is absent
  MISC_FEATURE (42)..(42): X42 is any amino acid or is absent
  MISC_FEATURE (43)..(43): X43 is any amino acid or is absent
  MISC_FEATURE (45)..(45): X45 is N, R, D, or E
  MISC_FEATURE (46)..(46): X46 is L or A
  MISC_FEATURE (47)..(47): X47 is T, H, L, or S
  MISC_FEATURE (48)..(48): X48 is I, V, or L
  MISC_FEATURE (49)..(49): X49 is A, I, S, or V
  MISC_FEATURE (51)..(51): X51 is F or Y
  MISC_FEATURE (52)..(52): X52 is R, K, or V
  MISC_FEATURE (53)..(53): X53 is M, I, T, L, or V
  MISC_FEATURE (54)..(54): X54 is G, E, A, S, T, or I
  MISC_FEATURE (55)..(55): X55 is G, S, D, R, K, Q, or D
  MISC_FEATURE (56)..(56): X56 is N, G, D, A, or M
  MISC_FEATURE (57)..(57): X57 is any amino acid or is absent
  MISC_FEATURE (58)..(58): X58 is any amino acid or is absent
  MISC_FEATURE (59)..(59): X59 is any amino acid or is absent
  MISC_FEATURE (60)..(60): X60 is any amino acid or is absent
  MISC_FEATURE (61)..(61): X61 is any amino acid or is absent
  MISC_FEATURE (62)..(62): X62 is any amino acid or is absent
  MISC_FEATURE (64)..(64): X64 is A, G, E, or T, or is absent
  MISC_FEATURE (65)..(65): X65 is I, R, H, Y, or is absent
  MISC_FEATURE (66)..(66): X6 is P or L
  MISC_FEATURE (67)..(67): X67 is I, L, or M
  MISC_FEATURE (68)..(68): X68 is T, Y, L, or F
  MISC_FEATURE (69)..(69): X69 is V, Y, F, L, or R
  MISC_FEATURE (70)..(70): X70 is M, I, R, or K
  MISC_FEATURE (73)..(73): X73 is T, A, Y, R, or F
  MISC_FEATURE (74)..(74): X74 is E, D, N, or L
  MISC_FEATURE (76)..(76): X76 is S, E, D, Q, or G
  MISC_FEATURE (77)..(77): X77 is Y, P, T, or D
  MISC_FEATURE (78)..(78): X78 is N, R, D, K, Q, or V
  MISC_FEATURE (79)..(79): X79 is K, Q, E, or R
  MISC_FEATURE (80)..(80): X80 is S, H, V, P, E, or L
  MISC_FEATURE (81)..(81): X81 is L or F
  MISC_FEATURE (83)..(83): X83 is A, Y, R, T, or E
  MISC_FEATURE (85)..(85): X85 is P, R, K, S, A, or L
  MISC_FEATURE (86)..(86): X86 is I, Y, R, V, L, M, or K
  MISC_FEATURE (87)..(87): X87 is R, K, S, or Q
  MISC_FEATURE (88)..(88): X88 is T, N, or S
  MISC_FEATURE (89)..(89): X89 is Q, P, T, L, or A
  MISC_FEATURE (90)..(90): X90 is P, G, S, D, or Q
  MISC_FEATURE (91)..(91): X91 is R, F, M, W, or Y
  MISC_FEATURE (93)..(93): X93 is N, D, W, S, L, K, or A
  MISC_FEATURE (94)..(94): X94 is S, T, R, E, P, or V, or is absent
  MISC_FEATURE (95)..(95): X95 is Y, F, P, R, S, or D
  MISC_FEATURE (96)..(96): X96 is Y, L, or S
  MISC_FEATURE (97)..(97): X97 is D, A, V, or T
  MISC_FEATURE (98)..(98): X98 is S, G, M, K, or P
  MISC_FEATURE (99)..(99): X99 is F, Y, T, or S
  MISC_FEATURE (100)..(100): X100 is S, A, M, or T
  MISC_FEATURE (101)..(101): X101 is A, Y, F,or L
  MISC_FEATURE (102)..(102): X102 is V, P, T, I, or L
  MISC_FEATURE (103)..(103): X103 is S, T, or G
  MISC_FEATURE (104)..(104): X104 is E, D, or R
  MISC_FEATURE (106)..(106): X106 is N, E, or G
  MISC_FEATURE (109)..(109): X109 is F or L
  MISC_FEATURE (110)..(110): X110 is L, I, V, or T
  MISC_FEATURE (111)..(111): X111 is M, I, F, or L
  MISC_FEATURE (112)..(112): X112 is H, A, V, M, or F
  MISC_FEATURE (113)..(113): X113 is A or S
  MISC_FEATURE (115)..(115): X115 is F, R, Q, P, or A
  MISC_FEATURE (116)..(116): X116 is E, L, F, or A
  MISC_FEATURE (117)..(117): X117 is T, V, N, or L
  MISC_FEATURE (118)..(118): X118 is A, E, S, D, or Q
  MISC_FEATURE (120)..(120): X120 is T, Q, or L
  MISC_FEATURE (122)..(122): X122 is L, R, or T
  MISC_FEATURE (124)..(124): X124 is L, A, V, or T
  MISC_FEATURE (125)..(125): X125 is V, L, or I
  MISC_FEATURE (126)..(126): X126 is K, Y, S, I, V, T, or Q
  MISC_FEATURE (127)..(127): X127 is I or V
  MISC_FEATURE (128)..(128): X128 is N, D, E, or G
  MISC_FEATURE (129)..(129): X129 is D, G, N, or R
  MISC_FEATURE (130)..(130): X130 is W, T, V, E, D, S, or F
  MISC_FEATURE (131)..(131): X131 is T, V, N, P, F, M, or A
  MISC_FEATURE (132)..(132): X132 is E, A, I, T, F, or Q
  MISC_FEATURE (133)..(133): X133 is I, Y, L, V, S, or T
  MISC_FEATURE (134)..(134): X134 is T, S, or A
  MISC_FEATURE (135)..(135): X135 is Q, D, or L
  MISC_FEATURE (136)..(136): X136 is F, I, or V
  MISC_FEATURE (137)..(137): X137 is I, M, L, or T
  MISC_FEATURE (138)..(138): X138 is L, V, or F
VXXXXXXXXXCXXXXLXXXXXXXXXXXXXXXXXXXXXXXXXXXYXXXXXWXXXXXXXXXXXXCXXXXXXXEYXXCXXXXXXGXCXXXXXXXWXXXXXXXXXXXXDXLGXXXXXPXXXXGXYXRXXXXXXXXXXXXXXX

SEQ ID NO: 747 - protein, 24 aa, Artificial Sequence
  Synthetic construct derived from human thought.
  MISC_FEATURE (1)..(1): X1 is any amino acid or is absent
  MISC_FEATURE (2)..(2): X1 is any amino acid or is absent
  MISC_FEATURE (3)..(3): X3 is any amino acid
  MISC_FEATURE (4)..(4): X4 is any amino acid
  MISC_FEATURE (5)..(5): X5 is any amino acid
  MISC_FEATURE (6)..(6): X6 is any amino acid
  MISC_FEATURE (7)..(7): X7 is any amino acid
  MISC_FEATURE (8)..(8): X8 is any amino acid
  MISC_FEATURE (10)..(10): X10 is Y or F
  MISC_FEATURE (11)..(11): X11 is A or S
  MISC_FEATURE (12)..(12): X12 is any amino acid or is absent
  MISC_FEATURE (13)..(13): X13 is any amino acid or is absent
  MISC_FEATURE (14)..(14): X14 is any amino acid or is absent
  MISC_FEATURE (15)..(15): X15 is any amino acid or is absent
  MISC_FEATURE (16)..(16): X16 is any amino acid
  MISC_FEATURE (17)..(17): X17 is any amino acid
  MISC_FEATURE (18)..(18): X18 is any amino acid
  MISC_FEATURE (19)..(19): X19 is any amino acid
  MISC_FEATURE (20)..(20): X20 is any amino acid
  MISC_FEATURE (21)..(21): X21 is any amino acid
  MISC_FEATURE (22)..(22): X22 is any amino acid
  MISC_FEATURE (23)..(23): X23 is A, L, or W
XXXXXXXXCXXXXXXXXXXXXXXC

SEQ ID NO: 748 - protein, 28 aa, Artificial Sequence
  Synthetic construct derived from human thought.
  MISC_FEATURE (2)..(2): X2 is any amino acid
  MISC_FEATURE (4)..(4): X4 is any amino acid
  MISC_FEATURE (5)..(5): X5 is any amino acid
  MISC_FEATURE (6)..(6): X6 is any amino acid
  MISC_FEATURE (8)..(8): X8 is any amino acid
  MISC_FEATURE (10)..(10): X10 is any amino acid or is absent
  MISC_FEATURE (12)..(12): X12 is any amino acid or is absent
  MISC_FEATURE (13)..(13): X13 is any amino acid
  MISC_FEATURE (15)..(15): X15 is any amino acid or is absent
  MISC_FEATURE (16)..(16): X16 is any amino acid or is absent
  MISC_FEATURE (17)..(17): X17 is any amino acid or is absent
  MISC_FEATURE (18)..(18): X18 is any amino acid or is absent
  MISC_FEATURE (19)..(19): X19 is any amino acid
  MISC_FEATURE (20)..(20): X20 is any amino acid
  MISC_FEATURE (21)..(21): X21 is any amino acid
  MISC_FEATURE (22)..(22): X22 is any amino acid
  MISC_FEATURE (23)..(23): X23 is any amino acid
  MISC_FEATURE (25)..(25): X25 is any amino acid
  MISC_FEATURE (26)..(26): X26 is any amino acid or is absent
  MISC_FEATURE (27)..(27): X27 is any amino acid or is absent
VXVXXXGXLXPXXFXXXXXXXXXVXXXY

SEQ ID NO: 749 - protein, 27 aa, Artificial Sequence
  Synthetic construct derived from human thought.
  MISC_FEATURE (10)..(10): X10 is any amino acid or is absent
  MISC_FEATURE (14)..(14): X14 is any amino acid or is absent
  MISC_FEATURE (15)..(15): X15 is any amino acid or is absent
  MISC_FEATURE (16)..(16): X16 is any amino acid or is absent
  MISC_FEATURE (17)..(17): X17 is any amino acid or is absent
  MISC_FEATURE (18)..(18): X18 is any amino acid
  MISC_FEATURE (19)..(19): X19 is any amino acid
  MISC_FEATURE (20)..(20): X20 is any amino acid
  MISC_FEATURE (21)..(21): X21 is any amino acid
  MISC_FEATURE (24)..(24): X24 is any amino acid
  MISC_FEATURE (25)..(25): X25 is any amino acid or is absent
  MISC_FEATURE (26)..(26): X26 is any amino acid or is absent
VTVDSIGMLXPRFXXXXXXXXTVXXXY

SEQ ID NO: 750 - protein, 35 aa, Artificial Sequence
  Synthetic construct derived from human thought
  MISC_FEATURE (2)..(2): X2 is any amino acid or is absent
  MISC_FEATURE (3)..(3): X3 is any amino acid
  MISC_FEATURE (4)..(4): X4 is any amino acid
  MISC_FEATURE (5)..(5): X5 is any amino acid
  MISC_FEATURE (6)..(6): X6 is any amino acid
  MISC_FEATURE (7)..(7): X7 is any amino acid
  MISC_FEATURE (18)..(18): X18 is any amino acid or is absent
  MISC_FEATURE (22)..(22): X22 is any amino acid or is absent
  MISC_FEATURE (23)..(23): X23 is any amino acid or is absent
  MISC_FEATURE (24)..(24): X24 is any amino acid or is absent
  MISC_FEATURE (25)..(25): X25 is any amino acid or is absent
  MISC_FEATURE (26)..(26): X26 is any amino acid
  MISC_FEATURE (27)..(27): X27 is any amino acid
  MISC_FEATURE (28)..(28): X28 is any amino acid
  MISC_FEATURE (29)..(29): X29 is any amino acid
  MISC_FEATURE (32)..(32): X32 is any amino acid or is absent
  MISC_FEATURE (33)..(33): X33 is any amino acid or is absent
  MISC_FEATURE (34)..(34): X34 is any amino acid or is absent
SXXXXXXGVTVDSIGMLXPRFXXXXXXXXTVXXXY

SEQ ID NO: 751 - protein, 38 aa, Artificial Sequence
  Synthetic construct derived from human thought.
  MISC_FEATURE (1)..(1): X1 is any amino acid or is absent
  MISC_FEATURE (2)..(2): X2 is any amino acid or is absent
  MISC_FEATURE (3)..(3): X3 is any amino acid or is absent
  MISC_FEATURE (4)..(4): X4 is any amino acid or is absent
  MISC_FEATURE (5)..(5): X4 is any amino acid
  MISC_FEATURE (6)..(6): X6 is any amino acid
  MISC_FEATURE (7)..(7): X7 is any amino acid
  MISC_FEATURE (8)..(8): X8 is any amino acid
  MISC_FEATURE (9)..(9): X9 is any amino acid
  MISC_FEATURE (10)..(10): X10 is any amino acid
  MISC_FEATURE (23)..(23): X23 is any amino acid or is absent
  MISC_FEATURE (24)..(24): X24 is any amino acid or is absent
  MISC_FEATURE (25)..(25): X25 is any amino acid or is absent
  MISC_FEATURE (26)..(26): X26 is any amino acid or is absent
  MISC_FEATURE (27)..(27): X27 is any amino acid
  MISC_FEATURE (28)..(28): X28 is any amino acid
  MISC_FEATURE (29)..(29): X29 is any amino acid
  MISC_FEATURE (30)..(30): X30 is any amino acid
  MISC_FEATURE (31)..(31): X31 is any amino acid
  MISC_FEATURE (34)..(34): X34 is any amino acid or is absent
  MISC_FEATURE (35)..(35): X35 is any amino acid or is absent
  MISC_FEATURE (36)..(36): X36 is any amino acid or is absent
  MISC_FEATURE (37)..(37): X37 is any amino acid or is absent
XXXXXXXXXXVTVDSIGMLPRFXXXXXXXXXTVXXXXY

SEQ ID NO: 752 - protein, 16 aa, Artificial Sequence
  Synthetic construct derived from human thought.
  MISC_FEATURE (1)..(1): X1 is any amino acid
  MISC_FEATURE (2)..(2): X2 is any amino acid
  MISC_FEATURE (4)..(4): X4 is any amino acid
  MISC_FEATURE (5)..(5): X5 is any amino acid
  MISC_FEATURE (7)..(7): X7 is any amino acid or is absent
  MISC_FEATURE (8)..(8): X8 is any amino acid or is absent
  MISC_FEATURE (9)..(9): X9 is any amino acid
  MISC_FEATURE (10)..(10): X10 is any amino acid
  MISC_FEATURE (11)..(11): X11 is any amino acid
  MISC_FEATURE (12)..(12): X12 is any amino acid
  MISC_FEATURE (13)..(13): X13 is any amino acid
  MISC_FEATURE (14)..(14): X14 is any amino acid
  MISC_FEATURE (15)..(15): X15 is any amino acid
XXLXXLXXXXXXXXXV

SEQ ID NO: 753 - protein, 19 aa, Artificial Sequence
  Synthetic construct derived from human thought.
  MISC_FEATURE (2)..(2): X2 is any amino acid
  MISC_FEATURE (4)..(4): X4 is any amino acid
  MISC_FEATURE (6)..(6): X6 is any amino acid
  MISC_FEATURE (8)..(8): X8 is any amino acid or is absent
  MISC_FEATURE (9)..(9): X9 is any amino acid or is absent
  MISC_FEATURE (10)..(10): X10 is any amino acid
  MISC_FEATURE (11)..(11): X11 is any amino acid
  MISC_FEATURE (12)..(12): X12 is any amino acid
  MISC_FEATURE (13)..(13): X13 is any amino acid
  MISC_FEATURE (14)..(14): X14 is any amino acid
  MISC_FEATURE (15)..(15): X15 is any amino acid
  MISC_FEATURE (16)..(16): X16 is any amino acid
PXLXGXLXXXXXXXXXVYH

SEQ ID NO: 754 - protein, 37 aa, Artificial Sequence
  Synthetic construct derived from human thought.
  MISC_FEATURE (1)..(1): X1 is any amino acid
  MISC_FEATURE (2)..(2): X2 is any amino acid
  MISC_FEATURE (4)..(4): X4 is any amino acid
  MISC_FEATURE (5)..(5): X5 is any amino acid
  MISC_FEATURE (7)..(7): X7 is any amino acid or is absent
  MISC_FEATURE (8)..(8): X8 is any amino acid or is absent
  MISC_FEATURE (9)..(9): X9 is any amino acid
  MISC_FEATURE (10)..(10): X10 is any amino acid
  MISC_FEATURE (11)..(11): X11 is any amino acid
  MISC_FEATURE (12)..(12): X12 is any amino acid
  MISC_FEATURE (13)..(13): X13 is any amino acid
  MISC_FEATURE (14)..(14): X14 is any amino acid
  MISC_FEATURE (15)..(15): X15 is any amino acid
  MISC_FEATURE (17)..(17): X17 is any amino acid or is absent
  MISC_FEATURE (18)..(18): X18 is any amino acid or is absent
  MISC_FEATURE (19)..(19): X19 is any amino acid or is absent
  MISC_FEATURE (20)..(20): X20 is any amino acid or is absent
  MISC_FEATURE (21)..(21): X21 is any amino acid or is absent
  MISC_FEATURE (22)..(22): X22 is any amino acid or is absent
  MISC_FEATURE (23)..(23): X23 is any amino acid
  MISC_FEATURE (24)..(24): X24 is any amino acid
  MISC_FEATURE (25)..(25): X25 is any amino acid
  MISC_FEATURE (26)..(26): X26 is any amino acid
  MISC_FEATURE (28)..(28): X28 is any amino acid or is absent
  MISC_FEATURE (30)..(30): X30 is any amino acid
  MISC_FEATURE (33)..(33): X33 is any amino acid
  MISC_FEATURE (34)..(34): X34 is any amino acid
  MISC_FEATURE (36)..(36): X36 is any amino acid
XXLXXLXXXXXXXXXVXXXXXXXXXXPXFXPPXXPXT

SEQ ID NO: 755 - protein, 17 aa, Artificial Sequence
  Synthetic construct derived from human thought
  MISC_FEATURE (2)..(2): X2 is any amino acid
  MISC_FEATURE (4)..(4): X4 is any amino acid
  MISC_FEATURE (6)..(6): X6 is any amino acid
  MISC_FEATURE (7)..(7): X7 is any amino acid
  MISC_FEATURE (8)..(8): X8 is any amino acid
  MISC_FEATURE (9)..(9): X9 is any amino acid
  MISC_FEATURE (10)..(10): X10 is any amino acid
  MISC_FEATURE (11)..(11): X11 is any amino acid
  MISC_FEATURE (12)..(12): X12 is any amino acid
  MISC_FEATURE (13)..(13): X13 is any amino acid
PXLXRXXXXXXXXRVYH

---

The invention claimed is:

1. A composition comprising an effective amount of:

(A) a single DNA plasmid that comprises
  (1) a nucleotide sequence that encodes
    (a) a fusion protein, the fusion protein comprising
      (i) one or more alphaherpesvirus glycoprotein D (gD) amino acid sequences comprising one or more gD receptor binding domains, and (ii) one or more antigens that are associated with a disease-causing agent, wherein the one or more gD amino acid sequences detectably facilitate dendritic cell uptake of the fusion protein, and
    (b) one or more Ewing's Sarcoma-associated Transcript-2 (EAT-2) amino acid sequences, and
  (2) one or more promoters that increase expression of the fusion protein and the one or more EAT-2 amino acid sequences;

(B) two or more DNA plasmids that collectively comprise
  (1) nucleotide sequences that encode
    (a) a fusion protein, the fusion protein comprising
      (i) one or more gD amino acid sequences comprising one or more gD receptor binding domains and (ii) one or more antigens associated with a disease-causing agent, wherein the one or more gD sequences detectably facilitate dendritic cell uptake of the fusion protein, and
    (b) one or more EAT-2 amino acid sequences, and
  (2) one or more promoters that increase expression of the fusion protein and the one or more EAT-2 amino acid sequences;

(C) a single mRNA molecule that comprises a nucleotide sequence that encodes
  (a) a fusion protein, the fusion protein comprising
    (i) one or more gD amino acid sequences comprising one or more gD receptor binding domains, wherein the one or more gD sequences detectably facilitate dendritic cell uptake of the fusion protein, and (ii) one or more antigens associated with a disease-causing agent, and
  (b) one or more EAT-2 amino acid sequences; or (D) two or more mRNA molecules that collectively comprise nucleotide sequences that encode
  (a) a fusion protein, the fusion comprising
    (i) one or more gD amino acid sequences comprising one or more gD receptor binding domains, wherein the one or more gD sequences detectably facilitate dendritic cell uptake of the fusion protein, and (ii) one or more antigens associated with a disease-causing agent, and
  (b) one or more EAT-2 amino acid sequences.

2. The composition of claim 1, wherein at least one of the antigens are associated with one or more polyubiquitin sequences.

3. The composition of claim 2, wherein at least one of the one or more gD sequences exhibits a detectable checkpoint inhibition function in target recipients.

4. The composition of claim 3, wherein the one or more nucleotide sequences of the one or more DNA plasmids or one or more mRNA molecules further encode one or more non-gD checkpoint modulating amino acid sequences.

5. The composition of claim 2, wherein the one or more gD sequences do not exhibit checkpoint inhibition in target recipients and the one or more nucleotide sequences of the one or more DNA plasmids or the one or more mRNA molecules further encode one or more non-gD checkpoint modulating amino acid sequences.

6. The composition of claim 2, wherein at least one of the antigens encoded by the one or more nucleotide sequences of the one or more DNA plasmids or the one or more mRNA molecules comprise a mutation that eliminates a glycosylation site in the corresponding unmutated antigen.

7. The composition of claim 1, wherein the composition comprises an effective amount of one or more DNA plasmids that are associated with transfection-facilitating calcium phosphate nanoparticles.

8. The composition of claim 7, wherein the one or more plasmids further comprise one or more expression-enhancing introns.

9. The composition of claim 1, wherein the one or more nucleotide sequences of the one or more DNA plasmids encode a plurality of antigens, wherein at least two of the antigens, when initially expressed, are separated from each other by an amino acid sequence comprising one or more self-cleavage sites.

10. The composition of claim 7, wherein the one or more nucleotide sequences of the one or more DNA plasmids further comprise a triclosan selection marker.

11. The composition of claim 8, wherein the one or more antigens comprise one or more pathogen antigens.

12. The composition of claim 11, wherein the one or more pathogen antigens comprise one or more Porcine Circovirus antigens, one or more Porcine Reproductive and Respiratory Syndrome Virus antigens, one or more African Swine Fever Virus Antigens, or a combination of some or all thereof.

* * * * *